United States Patent
Black et al.

(10) Patent No.: US 6,348,582 B1
(45) Date of Patent: Feb. 19, 2002

(54) PROKARYOTIC POLYNUCLEOTIDES POLYPEPTIDES AND THEIR USES

(75) Inventors: Michael Terence Black, Le Vesinet; John Edward Hodgson, Paris, both of (FR); David Justin Charles Knowles, Boroughbridge (GB); Raymond Winfield Reichard, Quakertown, PA (US); Richard O Nicholas, Collegeville, PA (US); Martin Karl Russel Burnham, Barto, PA (US); Julie M Pratt, Wigston Leicester (GB); Martin Rosenberg, Royersford, PA (US); Judith M Ward, Dorking (GB); Michael Arthur Lonetto, Collegeville, PA (US)

(73) Assignees: SmithKline Beecham Corporation, Philadelphia, PA (US); SmithKline Beecham plc, Brentford (GB)

( * ) Notice: Subject to any disclaimer, the term of this patent is extended or adjusted under 35 U.S.C. 154(b) by 0 days.

(21) Appl. No.: 08/936,165

(22) Filed: Sep. 23, 1997

Related U.S. Application Data

(60) Provisional application No. 60/027,032, filed on Sep. 24, 1996.

(51) Int. Cl.[7] .................. C07H 21/00; C07H 21/02; C12P 21/06; A61K 38/00

(52) U.S. Cl. .................. 536/23.1; 536/22.1; 435/69.1; 435/252.3; 435/320.1; 530/350; 514/2; 514/21; 424/185.1

(58) Field of Search .................. 435/69.1, 6, 252.3, 435/320.1, 325; 500/300, 350; 514/12, 2, 21; 424/185.1; 536/22.1, 23.1

(56) References Cited

FOREIGN PATENT DOCUMENTS

| EP | 0786519 | * | 7/1997 |
| WO | WO 94 01583 | | 1/1994 |
| WO | WO 94 06830 | | 3/1994 |

OTHER PUBLICATIONS

Vellanoweth, R.L., "*Bascillus Subtilis* and Other Gram Positive Bacteria", *Sonenshein, Hoch, Losick Eds. Amer. Soc. Microbiol.*, chapter 48, pp.699–711, (1993).

European Search Report completed Sep. 07, 1999 from corresponding European Application No. 97307485.9.

* cited by examiner

Primary Examiner—Avis M. Davenport
(74) Attorney, Agent, or Firm—Edward R. Gimmi; Thomas S. Deibert; William T. King

(57) ABSTRACT

The invention provides novel polypeptides and polynucleotides encoding such polypeptides and methods for producing such polypeptides by recombinant techniques. Also provided are methods for utilizing such polypeptides to screen for antibacterial compounds.

29 Claims, No Drawings

PROKARYOTIC POLYNUCLEOTIDES POLYPEPTIDES AND THEIR USES

RELATED APPLICATIONS

This application claims benefit of U.S. Provisional Application No. 60/027,032, filed Sep. 24, 1996.

FIELD OF THE INVENTION

This invention relates to newly identified polynucleotides and polypeptides, and their production and uses, as well as their variants, agonists and antagonists, and their uses. In particular, in these and in other regards, the invention relates to novel polynucleotides and polypeptides set forth in the Sequence Listing.

BACKGROUND OF THE INVENTION

The Staphylococci make up a medically important genera of microbes. They are known to produce two types of disease, invasive and toxigenic. Invasive infections are characterized generally by abscess formation effecting both skin surfaces and deep tissues. *Stapylococcus aureus* (herein "*S. aureus*") is the second leading cause of bacteremia in cancer patients. Osteomyelitis, septic arthritis, septic thrombophlebitis and acute bacterial endocarditis are also relatively common. There are at least three clinical conditions resulting from the toxigenic properties of Staphylococci. The manifestation of these diseases result from the actions of exotoxins as opposed to tissue invasion and bacteremia. These conditions include: Staphylococcal food poisoning, scalded skin syndrome and toxic shock syndrome.

While certain Staphylococcal proteins associated with pathogenicity have been identified, e.g., coagulase, hemolysins, leucocidins and exo and enterotoxins, very little is known concerning the temporal expression of such genes during infection and disease progression in a mammalian host. Discovering the sets of genes the bacterium is likely to be expressing at the different stages of infection, particularly when an infection is established, provides critical information for the screening and characterization of novel antibacterials which can interrupt pathogenesis. In addition to providing a fuller understanding of known proteins, such an approach will identify previously unrecognised targets.

GUG is used as an imitating nucleotide, rather than ATG, for a significant number of mRNA's in both Gram positive and Gram negative bacteria. Statistics on the frequency of NTG codons in the start codon for several bacterial species are available on line via computer (http://biochem.otago.ac.nz:800/Transterm/home_page.html). A discussion of initiation codons in B. subtilis is set forth in Vellanoweth, RL.1993 in *Bacillus subtilis and other Gram Positive Bacteria, Biochemistry, Physiology and Molecular Genetics*, Sonenshein, Hoch, Losick Eds. Amer. Soc. Microbiol, Washington D.C. p. 699–711. Vellenworth indicates a major difference between *B. subtilis* and the gram-negative organisms is in the choice of initiation codon. 91% of the sequenced *E. coli* genes start with AUG. By contrast, about 30% of *B. subtilis* and other clostridial branch gened start with UUG or GUG. Moreover, CUG functions as a start codon in *B. subtilis*. Mutations of an AUG initiation codon to GUG or UUG often cause decreased expression in *B. subtilis* and *E. coli*. Generally, translation efficiency is higher with AUG initiation codons. A strong Shine-Delgarno ribosome binding site, however, can compensate almost fully for a weak initiation codon. It has been reported that genes with a range of expression levels have initiation codons other than ATG in gram positives (Vellanoweth, RL.1993 in *Bacillus subtilis and other Gram Positive Bacteria, Biochemistry, Physiology and Molecular Genetics*, Sonenshein, Hoch, Losick Eds. Amer. Soc. Microbiol, Washington D.C. p.699–711).

Provided herein are ORF sequences from genes possessing GUG initiation codons and proteins expressed therefrom to be used for screening for antimicrobial compounds. Clearly, there is a need for polypeptide and polynucleotide sequences that may be used to screen for antimicrobial compound and which may also be used to determine the roles of such sequences in pathogenesis of infection, dysfunction and disease. There is also need, therefore, for identification and characterization of such sequences which may play a role in preventing, ameliorating or correcting infections, dysfunctions or diseases.

The polypeptides of the invention have amino acid sequence homology to a known protein(s) as set forth in Table 1.

SUMMARY OF THE INVENTION

It is an object of the invention to provide polypeptides that have been identified as novel polypeptides by homology between an amino acid sequence selected from the group consisting of the sequences set out in the Sequence Listing and a known amino acid sequence or sequences of other proteins such as the protein identities listed in Table 1.

It is a further object of the invention to provide polynucleotides that encode novel polypeptides, particularly polynucleotides that encode polypeptides of *Staphylococcus aureus*.

In a particularly preferred embodiment of the invention the polynucleotide comprises a region encoding a polypeptide comprising a sequence sequence selected from the group consisting of the sequences set out in the Sequence Listing, or a variant of any of these sequences.

In another particularly preferred embodiment of the invention there is a novel protein from *Staphylococcus aureus* comprising an amino acid sequence selected from the group consisting of the sequences set out in the Sequence Listing, or a variant of any of these sequences.

In accordance with another aspect of the invention there is provided an isolated nucleic acid molecule encoding a mature polypeptide expressible by the *Staphylococcus aureus* WCUH29 strain contained in the deposited strain.

A further aspect of the invention there are provided isolated nucleic acid molecules encoding a polypeptide of the invention, particularly *Staphylococcus aureus* polypeptide, and including mRNA, cDNAs, genomic DNAs. Further embodiments of the invention include biologically, diagnostically, prophylactically, clinically or therapeutically useful variants thereof, and compositions comprising the same.

In accordance with another aspect of the invention, there is provided the use of a polynucleotide of the invention for therapeutic or prophylactic purposes, in particular genetic immunization. Among the particularly preferred embodiments of the invention are naturally occurring allelic variants of a polypeptide of the invention and polypeptides encoded thereby.

Another aspect of the invention there are provided novel polypeptides of *Staphylococcus aureus* as well as biologically, diagnostically, prophylactically, clinically or therapeutically useful variants thereof, and compositions comprising the same.

Among the particularly preferred embodiments of the invention are variants of the polypeptides of the invention encoded by naturally occurring alleles of their genes.

In a preferred embodiment of the invention there are provided methods for producing the aforementioned polypeptides.

In accordance with yet another aspect of the invention, there are provided inhibitors to such polypeptides, useful as antibacterial agents, including, for example, antibodies.

In accordance with certain preferred embodiments of the invention, there are provided products, compositions and methods for assessing expression of the polypeptides and polynucleotides of the invention, treating disease, for example, infections of the upper respiratory tract (e.g., otitis media, bacterial tracheitis, acute epiglottitis, thyroiditis), lower respiratory (e.g., empyema, lung abscess), cardiac (e.g., infective endocarditis), gastrointestinal (e.g., secretory diarrhoea, splenic absces, retroperitoneal abscess), CNS (e.g., cerebral abscess), eye (e.g., blepharitis, conjunctivitis, keratitis, endophthalmitis, preseptal and orbital cellulitis, darcryocystitis), kidney and urinary tract (e.g., epididymitis, intrarenal and perinephric absces, toxic shock syndrome), skin (e.g., impetigo, folliculitis, cutaneous abscesses, cellulitis, wound infection, bacterial myositis) bone and joint (e.g., septic arthritis, osteomyelitis), assaying genetic variation, and administering a polypeptide or polynucleotide of the invention to an organism to raise an immunological response against a bacteria, especially a *Staphylococcus aureus* bacteria In accordance with certain preferred embodiments of this and other aspects of the invention there are provided polynucleotides that hybridize to a polynucleotide sequence of the invention, particularly under stringent conditions.

In certain preferred embodiments of the invention there are provided antibodies against polypeptides of the invention.

In other embodiments of the invention there are provided methods for identifying compounds which bind to or otherwise interact with and inhibit or activate an activity of a polypeptide or polynucleotide of the invention comprising: contacting a polypeptide or polynucleotide of the invention with a compound to be screened under conditions to permit binding to or other interaction between the compound and the polypeptide or polynucleotide to assess the binding to or other interaction with the compound, such binding or interaction being associated with a second component capable of providing a detectable signal in response to the binding or interaction of the polypeptide or polynucleotide with the compound; and determining whether the compound binds to or otherwise interacts with and activates or inhibits an activity of the polypeptide or polynucleotide by detecting the presence or absence of a signal generated from the binding or interaction of the compound with the polypeptide or polynucleotide.

In accordance with yet another aspect of the invention, there are provided agonists and antagonists of the polypeptides and polynucleotides of the invention, preferably bacteriostatic or bacteriocidal agonists and antagonists.

In a further aspect of the invention there are provided compositions comprising a polynucleotide or a polypeptide of the invention for administration to a cell or to a multicellular organism.

Various changes and modifications within the spirit and scope of the disclosed invention will become readily apparent to those skilled in the art from reading the following descriptions and from reading the other parts of the present disclosure.

Glossary

The following definitions are provided to facilitate understanding of certain terms used frequently herein.

"Host cell" is a cell which has been transformed or transfected, or is capable of transformation or transfection by an exogenous polynucleotide sequence.

"Identity," as known in the art, is a relationship between two or more polypeptide sequences or two or more polynucleotide sequences, as determined by comparing the sequences. In the art, "identity" also means the degree of sequence relatedness between polypeptide or polynucleotide sequences, as the case may be, as determined by the match between strings of such sequences. "Identity" and "similarity" can be readily calculated by known methods, including but not limited to those described in (*Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; and Carillo, H., and Lipman, D., SIAM *J. Applied Math.*, 48: 1073 (1988). Preferred methods to determine identity are designed to give the largest match between the sequences tested. Methods to determine identity and similarity are codified in publicly available computer programs. Preferred computer program methods to determine identity and similarity between two sequences include, but are not limited to, the GCG program package (Devereux, J., et al., *Nucleic Acids Research* 12(1): 387 (1984)), BLASTP, BLASTN, and FASTA (Atschul, S. F. et al., *J. Molec. Biol.* 215: 403–410 (1990). The BLAST X program is publicly available from NCBI and other sources (*BLAST Manual*, Altschul, S., et al., NCBI NLM NIH Bethesda, Md. 20894; Altschul, S., et al., *J. Mol. Biol.* 215: 403–410 (1990). As an illustration, by a polynucleotide having a nucleotide sequence having at least, for example, 95% "identity" to a reference nucleotide sequence it is intended that the nucleotide sequence of the tested polynucleotide is identical to the reference sequence except that the polynucleotide sequence may include up to five point mutations per each 100 nucleotides of the reference nucleotide sequence. In other words, to obtain a polynucleotide having a nucleotide sequence at least 95% identical to a reference nucleotide sequence, up to 5% of the nucleotides in the reference sequence may be deleted or substituted with another nucleotide, or a number of nucleotides up to 5% of the total nucleotides in the reference sequence may be inserted into the reference sequence. These mutations of the reference sequence may occur at the 5' or 3' terminal positions of the reference nucleotide sequence or anywhere between those terminal positions, interspersed either individually among nucleotides in the reference sequence or in one or more contiguous groups within the reference sequence. Analogously, by a polypeptide having an amino acid sequence having at least, for example, 95% identity to a reference amino acid sequence is intended that the test amino acid sequence of the polypeptide is identical to the reference sequence except that the polypeptide sequence may include up to five amino acid alterations per each 100 amino acids of the reference amino acid. In other words, to obtain a polypeptide having an amino acid sequence at least 95% identical to a reference amino acid sequence, up to 5% of the amino acid residues in the reference sequence may be deleted or substituted with another amino acid, or a number of amino acids up to 5% of the total amino acid residues in the reference sequence may be inserted into the reference sequence. These alterations of the reference sequence may occur at the amino or carboxy terminal positions of the reference amino acid sequence or anywhere between those terminal positions, interspersed either individually among residues in the reference sequence or in one or more contiguous groups within the reference sequence.

"Isolated" means altered "by the hand of man" from its natural state, i.e., if it occurs in nature, it has been changed or removed from its original environment, or both. For example, a polynucleotide or a polypeptide naturally present in a living organism is not "isolated," but the same polynucleotide or polypeptide separated from the coexisting materials of its natural state is "isolated", as the term is employed herein.

"Polynucleotide(s)" generally refers to any polyribonucleotide or polydeoxribonucleotide, which may be unmodified RNA or DNA or modified RNA or DNA. "Polynucleotide(s)" include, without limitation, single- and double-stranded DNA, DNA that is a mixture of single- and double-stranded regions or single-, double- and triple-stranded regions, single- and double-stranded RNA, and RNA that is mixture of single- and double-stranded regions, hybrid molecules comprising DNA and RNA that may be single-stranded or, more typically, double-stranded, or triple-stranded regions, or a mixture of single- and double-stranded regions. In addition, "polynucleotide" as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide. As used herein, the term "polynucleotide(s)" also includes DNAs or RNAs as described above that contain one or more modified bases. Thus, DNAs or RNAs with backbones modified for stability or for other reasons are "polynucleotide(s)" as that term is intended herein. Moreover, DNAs or RNAs comprising unusual bases, such as inosine, or modified bases, such as tritylated bases, to name just two examples, are polynucleotides as the term is used herein. It will be appreciated that a great variety of modifications have been made to DNA and RNA that serve many useful purposes known to those of skill in the art The term "polynucleotide(s)" as it is employed herein embraces such chemically, enzymatically or metabolically modified forms of polynucleotides, as well as the chemical forms of DNA and RNA characteristic of viruses and cells, including, for example, simple and complex cells. "Polynucleotide(s)" also embraces short polynucleotides often referred to as oligonucleotide(s).

"Polypeptide(s)" refers to any peptide or protein comprising two or more amino acids joined to each other by peptide bonds or modified peptide bonds. "Polypeptide(s)" refers to both short chains, commonly referred to as peptides, oligopeptides and oligomers and to longer chains generally referred to as proteins. Polypeptides may contain amino acids other than the 20 gene encoded amino acids. "Polypeptide(s)" include those modified either by natural processes, such as processing and other post-translational modifications, but also by chemical modification techniques. Such modifications are well described in basic texts and in more detailed monographs, as well as in a voluminous research literature, and they are well known to those of skill in the art. It will be appreciated that the same type of modification may be present in the same or varying degree at several sites in a given polypeptide. Also, a given polypeptide may contain many types of modifications. Modifications can occur anywhere in a polypeptide, including the peptide backbone, the amino acid side-chains, and the amino or carboxyl termini. Modifications include, for example, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent cross-links, formation of cysteine, formation of pyroglutamate, formylation, gamma-carboxylation, glycosylation, GPI anchor formation, hydroxylation, iodination, methylation, myristoylation, oxidation, proteolytic processing, phosphorylation, prenylation, racemization, glycosylation, lipid attachment, sulfation, gamma-carboxylation of glutamic acid residues, hydroxylation and ADP-ribosylation, selenoylation, sulfation, transfer-RNA mediated addition of amino acids to proteins, such as arginylation, and ubiquitination. See, for instance, *PROTEINS—STRUCTURE AND MOLECULAR PROPERTIES*, 2nd Ed., T. E. Creighton, W. H. Freeman and Company, New York (1993) and World, F., Posttranslational Protein Modifications: Perspectives and Prospects, pgs. 1–12 in *POSTTRANSLATIONAL COVALENT MODIFICATION OF PROTEINS*, B. C. Johnson, Ed., Academic Press, New York (1983); Seifter et al., *Meth. Enzymol.* 182:626–646 (1990) and Rattan et al., *Protein Synthesis: Posttranslational Modifications and Aging*, Ann. N.Y. Acad. Sci. 663: 48–62 (1992). Polypeptides may be branched or cyclic, with or without branching. Cyclic, branched and branched circular polypeptides may result from post-translational natural processes and may be made by entirely synthetic methods, as well.

"Variant(s)" as the term is used herein, is a polynucleotide or polypeptide that differs from a reference polynucleotide or polypeptide respectively, but retains essential properties. A typical variant of a polynucleotide differs in nucleotide sequence from another, reference polynucleotide. Changes in the nucleotide sequence of the variant may or may not alter the amino acid sequence of a polypeptide encoded by the reference polynucleotide. Nucleotide changes may result in amino acid substitutions, additions, deletions, fusions and truncations in the polypeptide encoded by the reference sequence, as discussed below. A typical variant of a polypeptide differs in amino acid sequence from another, reference polypeptide. Generally, differences are limited so that the sequences of the reference polypeptide and the variant are closely similar overall and, in many regions, identical. A variant and reference polypeptide may differ in amino acid sequence by one or more substitutions, additions, deletions in any combination. A substituted or inserted amino acid residue may or may not be one encoded by the genetic code. A variant of a polynucleotide or polypeptide may be a naturally occurring such as an allelic variant, or it may be a variant that is not known to occur naturally. Non-naturally occurring variants of polynucleotides and polypeptides may be made by mutagenesis techniques, by direct synthesis, and by other recombinant methods known to skilled artisans.

DESCRIPTION OF THE INVENTION

Each of polynucleotide and polypeptide sequences provided herein may be used in the discovery and development of antibacterial compounds. Upon expression of the sequences with the appropriate initiation and termination codons the encoded polypeptide can be used as a target for the screening of antimicrobial drugs. Additionally, the DNA sequences encoding preferably the amino terminal regions of the encoded protein or the Shine-Delgarno region can be used to construct antisense sequences to control the expression of the coding sequence of interest. Furthermore, many of the sequences disclosed herein also provide regions upstream and downstream from the encoding sequence. These sequences are useful as a source of regulatory elements for the control of bacterial gene expression. Such sequences are conveniently isolated by restriction enzyme action or synthesized chemically and introduced, for example, into promoter identification strains. These strains contain a reporter structural gene sequence located downstream from a restriction site such that if an active promoter is inserted, the reporter gene will be expressed.

Although each of the sequences may be employed as described above, this invention also provides several means for identifying particularly useful target genes. The first of these approaches entails searching appropriate databases for sequence matches in related organisms. Thus, if a homologue exists, the Streptococcal-like form of this gene would likely play an analogous role. For example, a Streptococcal protein identified as homologous to a cell surface protein in another organism would be useful as a vaccine candidate. To the extent such homologies have been identified for the sequences disclosed herein they are reported along with the encoding sequence.

Each of the DNA sequences provided herein may be used in the discovery and development of antibacterial compounds. Because each of the sequences contains an open reading frame (ORF) with an appropriate initiation and termination codons, the encoded protein upon expression can be used as a target for the screening of antimicrobial drugs. Additionally, the DNA sequences encoding the amino terminal regions of the encoded protein can be used to construct antisense sequences to control the expression of the coding sequence of interest. Furthermore, many of the sequences disclosed herein also provide regions upstream and downstream from the encoding sequence. These sequences are useful as a source of regulatory elements for the control of bacterial gene expression. Such sequences are conveniently isolated by restriction enzyme action or synthesized chemically and introduced, for example, into promoter identification strains. These strains contain a reporter structural gene sequence located downstream from a restriction site such that if an active promoter is inserted, the reporter gene will be expressed.

It is believed that bacteria possess a number of ways of regulating gene expression levels, especially in subtle degrees, and the interplay between ribosome binding site and initiation codon is utilized for this purpose for these genes. It is also believed that such genes will be important targets for antimicrobial drug discovery, particularly since pathogenesis genes are believed undergo gene expression regulation during in the pathogenesis process. Therefore, the invention provides ORF sequences possessing a GTG (GUG) initiation codon and protein targets expressed thereform.

Although each of the sequences may be employed as described above, this invention also provides several means for identifying particularly useful target genes. The first of these approaches entails searching appropriate databases for sequence matches in related organisms. Thus, if a homologue exists, the Staphylococcal-like form of this gene would likely play an analogous role. For example, a Staphylococcal protein identified as homologous to a cell surface protein in another organism would be useful as a vaccine candidate. To the extent such homologies have been identified for the sequences disclosed herein they are reported along with the encoding sequence.

ORF Gene Expression

Recently techniques have become available to evaluate temporal gene expression in bacteria, particularly as it applies to viability under laboratory and infection conditions. A number of methods can be used to identify genes which are essential to survival per se, or essential to the establishment/maintenance of an infection. Identification of an ORF unknown by one of these methods yields additional information about its function and permits the selection of such an ORF for further development as a screening target. Briefly, these approaches include:

1) Signature Tagged Mutagenesis (STM)

This technique is described by Hensel et al., *Science* 269: 400–403(1995), the contents of which is incorporated by reference for background purposes. Signature tagged mutagenesis identifies genes necessary for the establishment/maintenance of infection in a given infection model.

The basis of the technique is the random mutagenesis of target organism by various means (e.g., transposons) such that unique DNA sequence tags are inserted in close proximity to the site of mutation. The tags from a mixed population of bacterial mutants and bacteria recovered from an infected hosts are detected by amplification, radiolabeling and hybridisation analysis. Mutants attenuated in virulence are revealed by absence of the tag from the pool of bacteria recovered from infected hosts.

In *Staphylococcus aureus,* because the transposon system is less well developed, a more efficient way of creating the tagged mutants is to use the insertion-duplication mutagenesis technique as described by Morrison et al., *J. Bacteriol.* 159:870 (1984) the contents of which is incorporated by reference for background purposes.

2) In Vivo Expression Technology (IVET)

This technique is described by Camilli et al., *Proc. Nat'l. Acad. Sci. USA* 91:2634–2638 (1994), the contents of which is incorporated by reference for background purposes. IVET identifies genes up-regulated during infection when compared to laboratory cultivation, implying an important role in infection. ORF identified by this technique are implied to have a significant role in infection establishment/maintenance.

In this technique random chromosomal fragments of target organism are cloned upstream of a promoter-less recombinase gene in a plasmid vector. This construct is introduced into the target organism which carries an antibiotic resistance gene flanked by resolvase sites. Growth in the presence of the antibiotic removes from the population those fragments cloned into the plasmid vector capable of supporting transcription of the recombinase gene and therefore have caused loss of antibiotic resistance. The resistant pool is introduced into a host and at various times after infection bacteria may be recovered and assessed for the presence of antibiotic resistance. The chromosomal fragment carried by each antibiotic sensitive bacterium should carry a promoter or portion of a gene normally upregulated during infection. Sequencing upstream of the recombinase gene allows identification of the up regulated gene.

3) Differential Display

This technique is described by Chuang et al., *J. Bacteriol.* 175:2026–2036 (1993), the contents of which is incorporated by reference for background purposes. This method identifies those genes which are expressed in an organism by identifying mRNA present using randomly-primed RT-PCR. By comparing pre-infection and post infection profiles, genes up and down regulated during infection can be identified and the RT-PCR product sequenced and matched to ORF 'unknowns'.

4) Generation of Conditional Lethal Mutants by Transposon Mutagenesis

This technique, described by de Lorenzo, V. et al., *Gene* 123:17–24 (1993); Neuwald, A. F. et al., *Gene* 125: 69–73 (1993); and Takiff, H. E. et al., *J. Bacteriol.* 174:1544–1553 (1992), the contents of which is incorporated by reference for background purposes, identifies genes whose expression are essential for cell viability.

In this technique transposons carrying controllable promoters, which provide transcription outward from the transposon in one or both directions, are generated. Random insertion of these transposons into target organisms and subsequent isolation of insertion mutants in the presence of inducer of promoter activity ensures that insertions which separate promoter from coding region of a gene whose expression is essential for cell viability will be recovered. Subsequent replica plating in the absence of inducer identifies such insertions, since they fail to survive. Sequencing of the flanking regions of the transposon allows identification of site of insertion and identification of the gene disrupted. Close monitoring of the changes in cellular processes/morphology during growth in the absence of inducer yields information on likely function of the gene. Such monitoring could include flow cytometry (cell division, lysis, redox potential, DNA replication), incorporation of radiochemically labeled precursors into DNA, RNA, protein, lipid, peptidoglycan, monitoring reporter enzyme gene fusions which respond to known cellular stresses.

5) Generation of Conditional Lethal Mutants by Chemical Mutagenesis

This technique is described by Beckwith, *J. Methods in Enzymology* 204: 3–18(1991), the contents of which are incorporated herein by reference for background purposes. In this technique random chemical mutagenesis of target organism, growth at temperature other than physiological temperature (permissive temperature) and subsequent replica plating and growth at different temperature (e.g. 42° C. to identify ts, 25° C. to identify cs) are used to identify those isolates which now fail to grow (conditional mutants). As above close monitoring of the changes upon growth at the non-permissive temperature yields information on the function of the mutated gene. Complementation of conditional lethal mutation by library from target organism and sequencing of complementing gene allows matching with unknown ORF.

6) RT-PCR

*Staphylococcus aureus* messenger RNA is isolated from bacterial infected tissue e.g. 48 hour murine lung infections, and the amount of each mRNA species assessed by reverse transcription of the RNA sample primed with random hexanucleotides followed by PCR with gene specific primer pairs. The determination of the presence and amount of a particular mRNA species by quantification of the resultant PCR product provides information on the bacterial genes which are transcribed in the infected tissue. Analysis of gene transcription can be carried out at different times of infection to gain a detailed knowledge of gene regulation in bacterial pathogenesis allowing for a clearer understanding of which gene products represent targets for screens for novel antibacterials. Because of the gene specific nature of the PCR primers employed it should be understood that the bacterial mRNA preparation need not be free of mammalian RNA. This allows the investigator to carry out a simple and quick RNA preparation from infected tissue to obtain bacterial mRNA species which are very short lived in the bacterium (in the order of 2 minute halflives). Optimally the bacterial mRNA is prepared from infected murine lung tissue by mechanical disruption in the presence of TRIzole (GIBCO-BRL) for very short periods of time, subsequent processing according to the manufacturers of TRIzole reagent and DNAase treatment to remove contaminating DNA. Preferably the process is optimised by finding those conditions which give a maximum amount of *Staphylococcus aureus* 16S ribosomal RNA as detected by probing Northerns with a suitably labelled sequence specific oligonucleotide probe. Typically a 5' dye labelled primer is used in each PCR primer pair in a PCR reaction which is terminated optimally between 8 and 25 cycles. The PCR products are separated on 6% polyacrylamide gels with detection and quantification using GeneScanner (manufactured by ABI).

Each of these techniques may have advantages or disadvantage depending on the particular application. The skilled artisan would choose the approach that is the most relevant with the particular end use in mind.

Use of the of these technologies when applied to the ORFs of the present invention enables identification of bacterial proteins expressed during infection, inhibitors of which would have utility in anti-bacterial therapy.

The invention relates to novel polypeptides and polynucleotides as described in greater detail below. In particular, the invention relates to polypeptides and polynucleotides of *Staphylococcus aureus*, which is related by amino acid sequence homology to known polypeptide as set forth in Table 1. The invention relates especially to compounds having the nucleotide and amino acid sequence selected from the group consisting of the sequences set out in the Sequence Listing, and to the nucleotide sequences of the DNA in the deposited strain and amino acid sequences encoded thereby.

Deposited Materials

*S. aureus* WCUH 29 has been deposited at the National Collection of Industrial and Marine Bacteria Ltd. (NCIMB), Aberdeen, Scotland under number NCIMB 40771 on Sep. 11, 1995.

The *Staphylococcus aureus* strain deposit is referred to herein as "the deposited strain" or as "the DNA of the deposited strain."

The deposited stain contains the full length genes comprising the polynucleotides set forth in the Sequence Listing. The sequence of the polynucleotides contained in the deposited stain, as well as the amino acid sequence of the polypeptide encoded thereby, are controlling in the event of any conflict with any description of sequences herein.

The deposit of the deposited strain has been made under the terms of the Budapest Treaty on the International Recognition of the Deposit of Micro-organisms for Purposes of Patent Procedure. The strain will be irrevocably and without restriction or condition released to the public upon the issuance of a patent. The deposited strain is provided merely as convenience to those of skill in the art and is not an admission that a deposit is required for enablement, such as that required under 35 U.S.C. §112.

A license may be required to make, use or sell the deposited strain, and compounds derived therefrom, and no such license is hereby granted.

Polypeptides

The polypeptides of the invention include the polypeptides set forth in the Sequence Listing (in particular the mature polypeptide) as well as polypeptides and fragments, particularly those which have the biological activity of a polypeptide of the invention, and also those which have at least 50%, 60% or 70% identity to a polypeptide sequence selected from the group consisting of the sequences set out in the Sequence Listing or the relevant portion, preferably at least 80% identity to a polypeptide sequence selected from the group consisting of the sequences set out in the Sequence Listing, and more preferably at least 90% similarity (more preferably at least 90% identity) to a polypeptide sequence selected from the group consisting of the sequences set out in the Sequence Listing, and still more preferably at least 95% similarity (still more preferably at least 95% identity) to a polypeptide sequence selected from the group consisting of the sequences set out in the Sequence Listing, and also include portions of such polypeptides with such portion of the polypeptide generally containing at least 30 amino acids and more preferably at least 50 amino acids.

The invention also includes polypeptides of the formula:

$$X\text{---}(R_1)_n\text{---}(R_2)\text{---}(R_3)_n\text{---}Y$$

wherein, at the amino terminus, X is hydrogen, and at the carboxyl terminus, Y is hydrogen or a metal, $R_1$ and $R_3$ are any amino acid residue, n is an integer between 1 and 2000, and $R_2$ is an amino acid sequence of the invention, particularly an amino acid sequence selected from the group set forth in the Sequence Listing. In the formula above $R_2$ is oriented so that its amino terminal residue is at the left, bound to $R_1$, and its carboxy terminal residue is at the right, bound to $R_3$. Any stretch of amino acid residues denoted by either R group, where R is greater than 1, may be either a heteropolymer or a homopolymer, preferably a heteropolymer. In preferred embodiments n is an integer between 1 and 1000 or 2000.

A fragment is a variant polypeptide having an amino acid sequence that entirely is the same as part but not all of the amino acid sequence of the aforementioned polypeptides. As with polypeptides, fragments may be "free-standing," or comprised within a larger polypeptide of which they form a part or region, most preferably as a single continuous region, a single larger polypeptide.

Preferred fragments include, for example, truncation polypeptides having a portion of the amino acid sequence of the Sequence Listing, or of variants thereof, such as a continuous series of residues that includes the amino terminus, or a continuous series of residues that includes the carboxyl terminus. Degradation forms of the polypeptides of the invention in a host cell, particularly a *Staphylococcus aureus*, are also preferred. Further preferred are fragments characterized by structural or functional attributes such as fragments that comprise alpha-helix and alpha-helix forming regions, beta-sheet and beta-sheet-forming regions, turn and turn-forming regions, coil and coil-forming regions, hydrophilic regions, hydrophobic regions, alpha amphipathic regions, beta amphipathic regions, flexible regions, surface-forming regions, substrate binding region, and high antigenic index regions.

Also preferred are biologically active fragments which are those fragments that mediate activities of polypeptides of the invention, including those with a similar activity or an improved activity, or with a decreased undesirable activity. Also included are those fragments that are antigenic or immunogenic in an animal, especially in a human. Particularly preferred are fragments comprising receptors or domains of enzymes that confer a function essential for viability of *Staphylococcus aureus* or the ability to initiate, or maintain cause disease in an individual, particularly a human.

Variants that are fragments of the polypeptides of the invention may be employed for producing the corresponding full-length polypeptide by peptide synthesis; therefore, these variants may be employed as intermediates for producing the full-length polypeptides of the invention.

In addition to the standard single and triple letter representations for amino acids, the term "X" or "Xaa" is also used. "X" and "Xaa" mean that any of the twenty naturally occuring amino acids may appear at such a designated position in the polypeptide sequence.

Polynucleotides

The nucleotide sequences disclosed herein can be obtained by synthetic chemical techniques known in the art or can be obtained from *S. aureus* WCUH 29 by probing a DNA preparation with probes constructed from the particular sequences disclosed herein. Alternatively, oligonucleotides derived from a disclosed sequence can act as PCR primers in a process of PCR-based cloning of the sequence from a bacterial genomic source. It is recognised that such sequences will also have utility in diagnosis of the stage of infection and type of infection the pathogen has attained.

To obtain the polynucleotide encoding the protein using the DNA sequence given herein typically a library of clones of chromosomal DNA of *S. aureus* WCUH 29 in *E. coli* or some other suitable host is probed with a radiolabelled oligonucleotide, preferably a 17mer or longer, derived from the partial sequence. Clones carrying DNA identical to that of the probe can then be distinguished using high stringency washes. By sequencing the individual clones thus identified with sequencing primers designed from the original sequence it is then possible to extend the sequence in both directions to determine the full gene sequence. Conveniently such sequencing is performed using denatured double stranded DNA prepared from a plasmid clone. Suitable techniques are described by Maniatis, T., Fritsch, E. F. and Sambrook, J. in MOLECULAR CLONING, A Laboratory Manual, 2nd edition, 1989, Cold Spring Harbor Laboratory (see: Screening By Hybridization 1.90 and Sequencing Denatured Double-Stranded DNA Templates 13.70).

Moerover, another aspect of the invention relates to isolated polynucleotides that encode the polypeptides of the invention having a deduced amino acid sequence selected from the group consisting of the sequences in the Sequence Listing and polynucleotides closely related thereto and variants thereof.

Using the information provided herein, such as the polynucleotide sequences set out in the Sequence Listing, a polynucleotide of the invention encoding polypeptide may be obtained using standard cloning and screening methods, such as those for cloning and sequencing chromosomal DNA fragments from bacteria using *Staphylococcus aureus* WCUH29 cells as starting material, followed by obtaining a full length clone. For example, to obtain a polynucleotide sequence of the invention, such as a sequence set forth in the Sequence Listing, typically a library of clones of chromosomal DNA of *Staphylococcus aureus* WCUH29 in *E. coli* or some other suitable host is probed with a radiolabeled oligonucleotide, preferably a 17-mer or longer, derived from a partial sequence. Clones carrying DNA identical to that of the probe can then be distinguished using stringent conditions. By sequencing the individual clones thus identified with sequencing primers designed from the original sequence it is then possible to extend the sequence in both directions to determine the full gene sequence. Conveniently, such sequencing is performed using denatured double stranded DNA prepared from a plasmid clone. Suitable techniques are described by Maniatis, T., Fritsch, E. F. and Sambrook et al., *MOLECULAR CLONING, A LABORATORY MANUAL*, 2nd Ed.; Cold Spring Harbor Laboratory Press, Cold Spring Harbor, N.Y. (1989). (see in particular Screening By Hybridization 1.90 and Sequencing Denatured Double-Stranded DNA Templates 13.70). Illustrative of the invention, the polynucleotides set out in the Sequence Listing were discovered in a DNA library derived from *Staphylococcus aureus* WCUH29.

The DNA sequences set out in the Sequence Listing each contains at least one open reading frame encoding a protein having at least about the number of amino acid residues set forth in the Sequence Listing. The start and stop codons of each open reading frame (herein "ORF") DNA are the first three and the last three nuclotides of each polynucleotide set forth in the Sequence Listing.

Certain polynucleotides and polypeptides of the invention are structurally related to known proteins as set forth in Table 1. These proteins exhibit greatest homology to the homologue listed in Table 1 from among the known proteins.

The invention provides a polynucleotide sequence identical over its entire length to each coding sequence in the Sequence Listing. Also provided by the invention is the coding sequence for the mature polypeptide or a fragment thereof, by itself as well as the coding sequence for the mature polypeptide or a fragment in reading frame with other coding sequence, such as those encoding a leader or secretory sequence, a pre-, or pro- or prepro-protein sequence. The polynucleotide may also contain non-coding sequences, including for example, but not limited to non-coding 5' and 3' sequences, such as the transcribed, non-translated sequences, termination signals, ribosome binding sites, sequences that stabilize mRNA, introns, polyadenylation signals, and additional coding sequence which encode additional amino acids. For example, a marker sequence that facilitates purification of the fused polypeptide can be encoded. In certain embodiments of the invention, the marker sequence is a hexa-histidine peptide, as provided in the pQE vector (Qiagen, Inc.) and described in Gentz et al., *Proc. Nat. Acad. Sci., USA* 86: 821–824 (1989), or an HA tag (Wilson et al., *Cell* 37: 767 (1984). Polynucleotides of the invention also include, but are not limited to, polynucleotides comprising a structural gene and its naturally associated sequences that control gene expression.

The invention also includes polynucleotides of the formula:

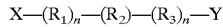

wherein, at the 5' end of the molecule, X is hydrogen, and at the 3' end of the molecule, Y is hydrogen or a metal, $R_1$ and $R_3$ is any nucleic acid residue, n is an integer between 1 and 3000, and $R_2$ is a nucleic acid sequence of the invention, particularly a nucleic acid sequence selected from the group set forth in the Sequence Listing. In the polynucleotide formula above $R_2$ is oriented so that its 5' end residue is at the left, bound to $R_1$, and its 3' end residue is at the right, bound to $R_3$. Any stretch of nucleic acid residues denoted by either R group, where R is greater than 1, may be either a heteropolymer or a homopolymer, preferably a heteropolymer. In a preferred embodiment n is an integer between 1 and 1000, or 2000 or 3000.

The term "polynucleotide encoding a polypeptide" as used herein encompasses polynucleotides that include a sequence encoding a polypeptide of the invention, particularly a bacterial polypeptide and more particularly a polypeptide of the *Staphylococcus aureus* having an amino acid sequence set out in the Sequence Listing. The term also encompasses polynucleotides that include a single continuous region or discontinuous regions encoding the polypeptide (for example, interrupted by integrated phage or an insertion sequence or editing) together with additional regions, that also may contain coding and/or non-coding sequences.

The invention further relates to variants of the polynucleotides described herein that encode for variants of the polypeptide having the deduced amino acid sequence of the Sequence Listing. Variants that are fragments of the polynucleotides of the invention may be used to synthesize full-length polynucleotides of the invention.

Further particularly preferred embodiments are polynucleotides encoding polypeptide variants, that have the amino acid sequence of a polypeptide of the Sequence Listing in which several, a few, 5 to 10, 1 to 5, 1 to 3, 2, 1 or no amino acid residues are substituted, deleted or added, in any combination. Especially preferred among these are silent substitutions, additions and deletions, that do not alter the properties and activities of such polynucleotide.

Further preferred embodiments of the invention are polynucleotides that are at least 50%, 60% or 70% identical over their entire length to a polynucleotide encoding a polypeptide having the amino acid sequence set out in the Sequence Listing, and polynucleotides that are complementary to such polynucleotides. Alternatively, most highly preferred are polynucleotides that comprise a region that is at least 80% identical over its entire length to a polynucleotide encoding a polypeptide of the deposited strain and polynucleotides complementary thereto. In this regard, polynucleotides at least 90% identical over their entire length to the same are particularly preferred, and among these particularly preferred polynucleotides, those with at least 95% are especially preferred. Furthermore, those with at least 97% are highly preferred among those with at least 95%, and among these those with at least 98% and at least 99% are particularly highly preferred, with at least 99% being the more preferred.

A preferred embodiment is an isolated polynucleotide comprising a polynucleotide sequence selected from the group consisting of: a polynucleotide having at least a 50% identity to a polynucleotide encoding a polypeptide comprising the amino acid sequence of the Sequence Listing and obtained from a prokaryotic species other than *S. aureus;* and a polynucleotide encoding a polypeptide comprising an amino acid sequence which is at least 50% identical to the amino acid sequence of the Sequence Listing and obtained from a prokaryotic species other than *S. aureus.*

Preferred embodiments are polynucleotides that encode polypeptides that retain substantially the same biological function or activity as the mature polypeptide encoded by the DNA of the Sequence Listing.

The invention further relates to polynucleotides that hybridize to the herein above-described sequences. In this regard, the invention especially relates to polynucleotides that hybridize under stringent conditions to the herein above-described polynucleotides. As herein used, the terms "stringent conditions" and "stringent hybridization conditions" mean hybridization will occur only if there is at least 95% and preferably at least 97% identity between the sequences. An example of stringent hybridization conditions is overnight incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing the hybridization support in 0.1×SSC at about 65° C. Hybridization and wash conditions are well known and exemplified in Sambrook, et al., Molecular Cloning: A Laboratory Manual, Second Edition, Cold Spring Harbor, N.Y., (1989), particularly Chapter 11 therein.

The invention also provides a polynucleotide consisting essentially of a polynucleotide sequence obtainable by screening an appropriate library containing the complete gene for a polynucleotide sequence set forth in the Sequence Listing under stringent hybridization conditions with a probe having the sequence of said polynucleotide sequence or a fragment thereof; and isolating said DNA sequence. Fragments useful for obtaining such a polynucleotide include, for example, probes and primers described elsewhere herein.

As discussed additionally herein regarding polynucleotide assays of the invention, for instance, polynucleotides of the invention as discussed above, may be used as a hybridization probe for RNA, cDNA and genomic DNA to isolate full-length cDNAs and genomic clones encoding a polypeptide and to isolate cDNA and genomic clones of other genes that have a high sequence similarity to a polynucleotide set forth in the Sequence Listing. Such probes generally will comprise at least 15 bases. Preferably, such probes will have at least 30 bases and may have at least 50 bases. Particularly preferred probes will have at least 30 bases and will have 50 bases or less.

For example, the coding region of each gene that comprises or is comprised by a polynucleotide set forth in the Sequence Listing may be isolated by screening using a DNA sequence provided in the Sequence Listing to synthesize an oligonucleotide probe. A labeled oligonucleotide having a sequence complementary to that of a gene of the invention is then used to screen a library of cDNA, genomic DNA or mRNA to determine which members of the library the probe hybridizes to.

The polynucleotides and polypeptides of the invention may be employed, for example, as research reagents and materials for discovery of treatments of and diagnostics for disease, particularly human disease, as further discussed herein relating to polynucleotide assays.

Polynucleotides of the invention that are oligonucleotides derived from the a polynucleotide or polypeptide sequence set forth in the Sequence Listing may be used in the processes herein as described, but preferably for PCR, to determine whether or not the polynucleotides identified herein in whole or in part are transcribed in bacteria in infected tissue. It is recognized that such sequences will also have utility in diagnosis of the stage of infection and type of infection the pathogen has attained.

The invention also provides polynucleotides that may encode a polypeptide that is the mature protein plus additional amino or carboxyl-terminal amino acids, or amino acids interior to the mature polypeptide (when the mature form has more than one polypeptide chain, for instance). Such sequences may play a role in processing of a protein from precursor to a mature form, may allow protein transport, may lengthen or shorten protein half-life or may facilitate manipulation of a protein for assay or production, among other things. As generally is the case in vivo, the additional amino acids may be processed away from the mature protein by cellular enzymes.

A precursor protein, having the mature form of the polypeptide fused to one or more prosequences may be an inactive form of the polypeptide. When prosequences are removed such inactive precursors generally are activated. Some or all of the prosequences may be removed before activation. Generally, such precursors are called proproteins.

In addition to the standard A, G, C, T/U representations for nucleic acid bases, the term "N" is also used. "N" means that any of the four DNA or RNA bases may appear at such a designated position in the DNA or RNA sequence, except it is preferred that N is not a base that when taken in combination with adjacent nucleotide positions, when read in the correct reading frame, would have the effect of generating a premature termination codon in such reading frame.

In sum, a polynucleotide of the invention may encode a mature protein, a mature protein plus a leader sequence (which may be referred to as a preprotein), a precursor of a mature protein having one or more prosequences that are not the leader sequences of a preprotein, or a preproprotein, which is a precursor to a proprotein, having a leader sequence and one or more prosequences, which generally are removed during processing steps that produce active and mature forms of the polypeptide.

Vectors Host Cells, Expression

The invention also relates to vectors that comprise a polynucleotide or polynucleotides of the invention, host cells that are genetically engineered with vectors of the invention and the production of polypeptides of the invention by recombinant techniques. Cell-free translation systems can also be employed to produce such proteins using RNAs derived from the DNA constructs of the invention.

For recombinant production, host cells can be genetically engineered to incorporate expression systems or portions thereof or polynucleotides of the invention. Introduction of a polynucleotide into the host cell can be effected by methods described in many standard laboratory manuals, such as Davis et al., *BASIC METHODS IN MOLECULAR BIOLOGY*, (1986) and Sambrook et al., *MOLECULAR CLONING: A LABORATORY MANUAL*, 2nd Ed., Cold Spring Harbor Laboratory Press, Cold Spring Harbor, N.Y. (1989), such as, calcium phosphate transfection, DEAE-dextran mediated transfection, transvection, microinjection, cationic lipid-mediated transfection, electroporation, transduction, scrape loading, ballistic introduction and infection.

Representative examples of appropriate hosts include bacterial cells, such as staphylococci, staphylococci, enterococci *E. coli*, streptomyces and *Bacillus subtilis* cells; fungal cells, such as yeast cells and Aspergillus cells; insect cells such as Drosophila S2 and Spodoptera Sf9 cells; animal cells such as CHO, COS, HeLa, C127, 3T3, BHK, 293 and Bowes melanoma cells; and plant cells.

A great variety of expression systems can be used to produce the polypeptides of the invention. Such vectors include, among others, chromosomal, episomal and virus-derived vectors, e.g., vectors derived from bacterial plasmids, from bacteriophage, from transposons, from yeast episomes, from insertion elements, from yeast chromosomal elements, from viruses such as baculoviruses, papova viruses, such as SV40, vaccinia viruses, adenoviruses, fowl pox viruses, pseudorabies viruses and retroviruses, and vectors derived from combinations thereof, such as those derived from plasmid and bacteriophage genetic elements, such as cosmids and phagemids. The expression system constructs may contain control regions that regulate as well as engender expression. Generally, any system or vector suitable to maintain, propagate or express polynucleotides and/or to express a polypeptide in a host may be used for expression in this regard. The appropriate DNA sequence may be inserted into the expression system by any of a variety of well-known and routine techniques, such as, for example, those set forth in Sambrook et al., *MOLECULAR CLONING, A LABORATORY MANUAL,* (supra).

For secretion of the translated protein into the lumen of the endoplasmic reticulum, into the periplasmic space or into the extracellular environment, appropriate secretion signals may be incorporated into the expressed polypeptide. These signals may be endogenous to the polypeptide or they may be heterologous signals.

Polypeptides of the invention can be recovered and purified from recombinant cell cultures by well-known methods including ammonium sulfate or ethanol precipitation, acid extraction, anion or cation exchange chromatography, phosphocellulose chromatography, hydrophobic interaction chromatography, affinity chromatography, hydroxylapatite chromatography, and lectin chromatography. Most preferably, high performance liquid chromatography is employed for purification. Well known techniques for refolding protein may be employed to regenerate active conformation when the polypeptide is denatured during isolation and or purification.

Diagnostic Assays

This invention is also related to the use of the polynucleotides of the invention for use as diagnostic reagents. Detection of such polynucleotides in a eukaryote, particularly a mammal, and especially a human, will provide a diagnostic method for diagnosis of a disease. Eukaryotes (herein also "individual(s)"), particularly mammals, and especially humans, infected with an organism comprising a gene of the invention may be detected at the nucleic acid level by a variety of techniques.

Nucleic acids for diagnosis may be obtained from an infected individual's cells and tissues, such as bone, blood, muscle, cartilage, and skin. Genomic DNA may be used directly for detection or may be amplified enzymatically by using PCR or other amplification technique prior to analysis. RNA or cDNA may also be used in the same ways. Using amplification, characterization of the species and strain of prokaryote present in an individual, may be made by an analysis of the genotype of the prokaryote gene. Deletions and insertions can be detected by a change in size of the amplified product in comparison to the genotype of a reference sequence. Point mutations can be identified by hybridizing amplified DNA to labeled polynucleotide sequences of the invention. Perfectly matched sequences can be distinguished from mismatched duplexes by RNase digestion or by differences in melting temperatures. DNA sequence differences may also be detected by alterations in the electrophoretic mobility of the DNA fragments in gels, with or without denaturing agents, or by direct DNA sequencing. See, e.g., Myers et al., *Science,* 230: 1242 (1985). Sequence changes at specific locations also may be revealed by nuclease protection assays, such as RNase and S1 protection or a chemical cleavage method. See, e.g., Cotton et al., *Proc. Natl. Acad. Sci., USA,* 85: 4397–4401 (1985).

Cells carrying mutations or polymorphisms in the gene of the invention may also be detected at the DNA level by a variety of techniques, to allow for serotyping, for example. For example, RT-PCR can be used to detect mutations. It is particularly preferred to used RT-PCR in conjunction with automated detection systems, such as, for example, GeneScan. RNA or cDNA may also be used for the same purpose, PCR or RT-PCR. As an example, PCR primers complementary to a nucleic acid encoding a polypeptide of the invention can be used to identify and analyze mutations. These primers may be used for, among other things, amplifying a DNA of the invention isolated from a sample derived from an individual. The primers may be used to amplify the gene isolated from an infected individual such that the gene may then be subject to various techniques for elucidation of the DNA sequence. In this way, mutations in the DNA sequence may be detected and used to diagnose infection and to serotype and/or classify the infectious agent.

The invention further provides a process for diagnosing disease, preferably bacterial infections, more preferably infections by *Staphylococcus aureus,* and most preferably disease, such as, infections of the upper respiratory tract (e.g., otitis media, bacterial tracheitis, acute epiglottitis, thyroiditis), lower respiratory (e.g., empyema, lung abscess), cardiac (e.g., infective endocarditis), gastrointestinal (e.g., secretory diarrhoea, splenic absces, retroperitoneal abscess), CNS (e.g., cerebral abscess), eye (e.g., blepharitis, conjunctivitis, keratitis, endophthalmitis, preseptal and orbital cellulitis, darcryocystitis), kidney and urinary tract (e.g., epididymitis, intrarenal and perinephric absces, toxic shock syndrome), skin (e.g., impetigo, folliculitis, cutaneous abscesses, cellulitis, wound infection, bacterial myositis) bone and joint (e.g., septic arthritis, osteomyelitis), comprising determining from a sample derived from an individual a increased level of expression of polynucleotide having the sequence of the Sequence Listing. Increased or decreased expression of a polynucleotide of the invention can be measured using any on of the methods well known in the art for the quantitation of polynucleotides, such as, for example, amplification, PCR, RT-PCR, RNase protection, Northern blotting and other hybridization methods.

In addition, a diagnostic assay in accordance with the invention for detecting over-expression of a polypeptide of the invention compared to normal control tissue samples may be used to detect the presence of an infection, for example. Assay techniques that can be used to determine levels of a protein, in a sample derived from a host are well-known to those of skill in the art. Such assay methods include radioimmunoassays, competitive-binding assays, Western Blot analysis and ELISA assays.

Antibodies

The polypeptides of the invention or variants thereof, or cells expressing them can be used as an immunogen to produce antibodies immunospecific for such polypeptides. "Antibodies" as used herein includes monoclonal and polyclonal antibodies, chimeric, single chain, simianized antibodies and humanized antibodies, as well as Fab fragments, including the products of an Fab immunolglobulin expression library.

Antibodies generated against the polypeptides of the invention can be obtained by administering the polypeptides or epitope-bearing fragments, analogues or cells to an animal, preferably a nonhuman, using routine protocols. For preparation of monoclonal antibodies, any technique known in the art that provides antibodies produced by continuous cell line cultures can be used. Examples include various techniques, such as those in Kohler, G. and Milstein, C., *Nature* 256: 495–497 (1975); Kozbor et al., *Immunology Today* 4: 72 (1983); Cole et al., pg. 77–96 in *MONOCLONAL ANTIBODIES AND CANCER THERAPY,* Alan R. Liss, Inc. (1985).

Techniques for the production of single chain antibodies (U.S. Pat. No. 4,946,778) can be adapted to produce single chain antibodies to polypeptides of this invention. Also, transgenic mice, or other organisms such as other mammals, may be used to express humanized antibodies.

Alternatively phage display technology may be utilized to select antibody genes with binding activities towards the polypeptide either from repertoires of PCR amplified v-genes of lymphocytes from humans screened for possessing recognition of a polypeptide of the invention or from naive libraries (McCafferty, J. et al., (1990), *Nature* 348, 552–554; Marks, J. et al., (1992) Biotechnology 10, 779–783). The affinity of these antibodies can also be improved by chain shuffling (Clackson, T. et al., (1991) Nature 352, 624–628).

If two antigen binding domains are present each domain may be directed against a different epitope—termed 'bispecific' antibodies.

The above-described antibodies may be employed to isolate or to identify clones expressing the polypeptides to purify the polypeptides by affinity chromatography.

Thus, among others, antibodies against a polypeptide of the invention may be employed to treat infections, particularly bacterial infections and especially infections of the upper respiratory tract (e.g., otitis media, bacterial tracheitis, acute epiglottitis, thyroiditis), lower respiratory (e.g., empyema, lung abscess), cardiac (e.g., infective endocarditis), gastrointestinal (e.g., secretory diarrhoea, splenic absces, retroperitoneal abscess), CNS (e.g., cerebral abscess), eye (e.g., blepharitis, conjunctivitis, keratitis, endophthalmitis, preseptal and orbital cellulitis, darcryocystitis), kidney and urinary tract (e.g., epididymitis, intrarenal and perinephric absces, toxic shock syndrome), skin (e.g., impetigo, folliculitis, cutaneous abscesses, cellulitis, wound infection, bacterial myositis) bone and joint (e.g., septic arthritis, osteomyelitis).

Polypeptide variants include antigenically, epitopically or immunologically equivalent variants that form a particular aspect of this invention. The term "antigenically equivalent derivative" as used herein encompasses a polypeptide or its equivalent which will be specifically recognized by certain antibodies which, when raised to the protein or polypeptide according to the invention, interfere with the immediate physical interaction between pathogen and mammalian host. The term "immunologically equivalent derivative" as used herein encompasses a peptide or its equivalent which when used in a suitable formulation to raise antibodies in a vertebrate, the antibodies act to interfere with the immediate physical interaction between pathogen and mammalian host.

The polypeptide, such as an antigenically or immunologically equivalent derivative or a fusion protein thereof is used as an antigen to immunize a mouse or other animal such as a rat or chicken. The fusion protein may provide stability to the polypeptide. The antigen may be associated, for example by conjugation, with an immunogenic carrier protein for example bovine serum albumin (BSA) or keyhole limpet haemocyanin (KLH). Alternatively a multiple antigenic peptide comprising multiple copies of the protein or polypeptide, or an antigenically or immunologically equivalent polypeptide thereof may be sufficiently antigenic to improve immunogenicity so as to obviate the use of a carrier.

Preferably, the antibody or variant thereof is modified to make it less immunogenic in the individual. For example, if the individual is human the antibody may most preferably be "humanized"; where the complimentarity determining region(s) of the hybridoma-derived antibody has been transplanted into a human monoclonal antibody, for example as described in Jones, P. et al. (1986), *Nature* 321, 522–525 or Tempest et al.,(1991) *Biotechnology* 9, 266–273.

The use of a polynucleotide of the invention in genetic immunization will preferably employ a suitable delivery method such as direct injection of plasmid DNA into muscles (Wolff et al., Hum Mol Genet 1992, 1:363, Manthorpe et al., Hum. Gene Ther. 1963:4, 419), delivery of DNA complexed with specific protein carriers (Wu et al., J Biol Chem. 1989: 264,16985), coprecipitation of DNA with calcium phosphate (Benvenisty & Reshef, PNAS, 1986:83, 9551), encapsulation of DNA in various forms of liposomes (Kaneda et al., Science 1989:243,375), particle bombardment (Tang et al., Nature 1992, 356:152, Eisenbraun et al., DNA Cell Biol 1993, 12:791) and in vivo infection using cloned retroviral vectors (Seeger et al., PNAS 1984:81, 5849).

Antagonists and Agonists—assays and Molecules

Polypeptides of the invention may also be used to assess the binding of small molecule substrates and ligands in, for example, cells, cell-free preparations, chemical libraries, and natural product mixtures. These substrates and ligands may be natural substrates and ligands or may be structural or functional mimetics. See, e.g., Coligan et al., *Current Protocols in Immunology* 1(2): Chapter 5 (1991).

The invention also provides a method of screening compounds to identify those which enhance (agonist) or block (antagonist) the action of a polypeptides or polynucleotides of the invention, particularly those compounds that are bacteriostatic and/or bacteriocidal. The method of screening may involve high-throughput techniques. For example, to screen for agonists or antagoists, a synthetic reaction mix, a cellular compartment, such as a membrane, cell envelope or cell wall, or a preparation of any thereof, comprising a polypeptide of the invention and a labeled substrate or ligand of such polypeptide is incubated in the absence or the presence of a candidate molecule that may be an agonist or antagonist of a polypeptide of the invention. The ability of the candidate molecule to agonize or antagonize a polypeptide of the invention is reflected in decreased binding of the labeled ligand or decreased production of product from such substrate. Molecules that bind gratuitously, i.e., without inducing the effects of a polypeptide of the invention are most likely to be good antagonists. Molecules that bind well and increase the rate of product production from substrate are agonists. Detection of the rate or level of production of product from substrate may be enhanced by using a reporter system. Reporter systems that may be useful in this regard include but are not limited to colorimetric labeled substrate converted into product, a reporter gene that is responsive to changes in polynucleotide or polypeptide activity, and binding assays known in the art.

Another example of an assay for antagonists of polypeptides of the invention is a competitive assay that combines any such polypeptide and a potential antagonist with a compound which binds such polypeptide, natural substrates or ligands, or substrate or ligand mimetics, under appropriate conditions for a competitive inhibition assay. A polypeptide of the invention can be labeled, such as by radioactivity or a colorimetric compound, such that the number of such polypeptide molecules bound to a binding molecule or converted to product can be determined accurately to assess the effectiveness of the potential antagonist.

Potential antagonists include small organic molecules, peptides, polypeptides and antibodies that bind to a polynucleotide or polypeptide of the invention and thereby inhibit or extinguish its activity. Potential antagonists also may be small organic molecules, a peptide, a polypeptide such as a closely related protein or antibody that binds the same sites on a binding molecule, such as a binding molecule, without inducing activities induced by a polypeptide of the invention, thereby preventing the action of such polypeptide by excluding it from binding.

Potential antagonists include a small molecule that binds to and occupies the binding site of the polypeptide thereby preventing binding to cellular binding molecules, such that normal biological activity is prevented. Examples of small molecules include but are not limited to small organic molecules, peptides or peptide-like molecules. Other potential antagonists include antisense molecules (see Okano, J. Neurochem 56: 560 (1991); OLIGODEOXYNUCLE-OTIDES AS ANTISENSE INHIBITORS OF GENE EXPRESSION, CRC Press, Boca Raton, Fla. (1988), for a description of these molecules). Preferred potential antagonists include compounds related to and variants of a polypeptide of the invention.

Each of the DNA sequences provided herein may be used in the discovery and development of antibacterial compounds. The encoded protein, upon expression, can be used as a target for the screening of antibacterial drugs. Additionally, the DNA sequences encoding the amino terminal regions of the encoded protein or Shine-Delgarno or other translation facilitating sequences of the respective mRNA can be used to construct antisense sequences to control the expression of the coding sequence of interest.

The invention also provides the use of the polypeptide, polynucleotide or inhibitor of the invention to interfere with the initial physical interaction between a pathogen and mammalian host responsible for sequelae of infection. In particular the molecules of the invention may be used: in the prevention of adhesion of bacteria, in particular gram positive bacteria, to mammalian extracellular matrix proteins on in-dwelling devices or to extracellular matrix proteins in wounds; to block protein-mediated mammalian cell invasion by, for example, initiating phosphorylation of mammalian tyrosine kinases (Rosenshine et al., Infect. Immun. 60:2211 (1992); to block bacterial adhesion between mammalian extracellular matrix proteins and bacterial proteins that mediate tissue damage and; to block the normal progression of pathogenesis in infections initiated other than by the implantation of in-dwelling devices or by other surgical techniques.

The antagonists and agonists of the invention may be employed, for instance, to inhibit and teat disease, such as, infections of the upper respiratory tract (e.g., otitis media, bacterial tracheitis, acute epiglottitis, thyroiditis), lower respiratory (e.g., empyema, lung abscess), cardiac (e.g., infective endocarditis), gastrointestinal (e.g., secretory diarrhoea, splenic absces, retroperitoneal abscess), CNS (e.g., cerebral abscess), eye (e.g., blepharitis, conjunctivitis, keratitis, endophthalmitis, preseptal and orbital cellulitis, darcryocystitis), kidney and urinary tract (e.g., epididymitis, intrarenal and perinephric absces, toxic shock syndrome), skin (e.g., impetigo, folliculitis, cutaneous abscesses, cellulitis, wound infection, bacterial myositis) bone and joint (e.g., septic arthritis, osteomyelitis).

Helicobacter pylori (herein H. pylori) bacteria infect the stomachs of over one-third of the world's population causing stomach cancer, ulcers, and gastritis (International Agency for Research on Cancer (1994) Schistosomes, Liver Flukes and Helicobacter pylori (International Agency for Research on Cancer, Lyon, France; ttp://www.uicc.ch/ecp/ecp2904.htm). Moreover, the international Agency for Research on Cancer recently recognized a cause-and-effect relationship between H. pylori and gastric adenocarcinoma, classifying the bacterium as a Group I (definite) carcinogen. Preferred antimicrobial compounds of the invention found using screens provided by the invention, particularly broad-spectrum antibiotics, should be useful in the treatment of H. pylori infection. Such treatment should decrease the advent of H. pylori-induced cancers, such as gastrointestinal carcinoma Such treatment should also cure gastric ulcers and gastritis.

Vaccines

Another aspect of the invention relates to a method for inducing an immunological response in an individual, particularly a mammal which comprises inoculating the individual with a polypeptide of the invention, or a fragment or variant thereof, adequate to produce antibody and/ or T cell immune response to protect said individual from infection, particularly bacterial infection and most particularly Staphylococcus aureus infection. Also provided are methods whereby such immunological response slows bacterial replication. Yet another aspect of the invention relates to a method of inducing immunological response in an individual which comprises delivering to such individual a nucleic acid vector to direct expression of a polynucleotide or polypeptide of the invention, or a fragment or a variant thereof, for expressing such polynucleotide or polypeptide, or a fragment or a variant thereof in vivo in order to induce an immunological response, such as, to produce antibody and/or T cell immune response, including, for example, cytokine-producing T cells or cytotoxic T cells, to protect said individual from disease, whether that disease is already established within the individual or not. One way of administering the gene is by accelerating it into the desired cells as a coating on particles or otherwise. Such nucleic acid vector may comprise DNA, RNA, a modified nucleic acid, or a DNA/RNA hybrid.

A further aspect of the invention relates to an immunological composition which, when introduced into an individual capable or having induced within it an immunological response, induces an immunological response in such individual to a polynucleotide of the invention or protein coded therefrom, wherein the composition comprises a recombinant polynucleotide or protein coded therefrom comprising DNA which codes for and expresses an antigen of said polynucleotide or protein coded therefrom. The immunological response may be used therapeutically or prophylactically and may take the form of antibody immunity or cellular immunity such as that arising from CTL or CD4+ T cells.

A polypeptide of the invention or a fragment thereof may be fused with co-protein which may not by itself produce antibodies, but is capable of stabilizing the first protein and producing a fused protein which will have immunogenic and protective properties. Thus fused recombinant protein, preferably further comprises an antigenic co-protein, such as lipoprotein D from Hemophilus influenzae, Glutathione-S-transferase (GST) or beta-galactosidase, relatively large co-proteins which solubilize the protein and facilitate production and purification thereof. Moreover, the co-protein may act as an adjuvant in the sense of providing a generalized stimulation of the immune system. The co-protein may be attached to either the amino or carboxy terminus of the first protein.

Provided by this invention are compositions, particularly vaccine compositions, and methods comprising the polypeptides or polynucleotides of the invention and immunostimulatory DNA sequences, such as those described in Sato, Y. et al. Science 273: 352 (1996).

Also, provided by this invention are methods using the described polynucleotide or particular fragments thereof which have been shown to encode non-variable regions of bacterial cell surface proteins in DNA constructs used in such genetic immunization experiments in animal models of infection with Staphylococcus aureus will be particularly useful for identifying protein epitopes able to provoke a prophylactic or therapeutic immune response. It is believed that this approach will allow for the subsequent preparation of monoclonal antibodies of particular value from the requisite organ of the animal successfully resisting or clearing infection for the development of prophylactic agents or therapeutic treatments of bacterial infection, particularly *Staphylococcus aureus* infection, in mammals, particularly humans.

The polypeptide may be used as an antigen for vaccination of a host to produce specific antibodies which protect against invasion of bacteria, for example by blocking adherence of bacteria to damaged tissue. Examples of tissue damage include wounds in skin or connective tissue caused, e.g., by mechanical, chemical or thermal damage or by implantation of indwelling devices, or wounds in the mucous membranes, such as the mouth, mammary glands, urethra or vagina.

The invention also includes a vaccine formulation which comprises an immunogenic recombinant protein of the invention together with a suitable carrier. Since the protein may be broken down in the stomach, it is preferably administered parenterally, including, for example, administration that is subcutaneous, intramuscular, intravenous, or intradermal. Formulations suitable for parenteral administration include aqueous and non-aqueous sterile injection solutions which may contain anti-oxidants, buffers, bacteriostats and solutes which render the formulation isotonic with the bodily fluid, preferably the blood, of the individual; and aqueous and non-aqueous sterile suspensions which may include suspending agents or thickening agents. The formulations may be presented in unit-dose or multi-dose containers, for example, sealed ampules and vials and may be stored in a freeze-dried condition requiring only the addition of the sterile liquid carrier immediately prior to use. The vaccine formulation may also include adjuvant systems for enhancing the immunogenicity of the formulation, such as oil-in water systems and other systems known in the art. The dosage will depend on the specific activity of the vaccine and can be readily determined by routine experimentation.

While the invention has been described with reference to certain protein, such as, for example, those set forth in the Sequence Listing, it is to be understood that this covers fragments of the naturally occurring protein and similar proteins with additions, deletions or substitutions which do not substantially affect the immunogenic properties of the recombinant protein.

Composition, Kits and Administration

The invention also relates to compositions comprising the polynucleotide or the polypeptides discussed above or their agonists or antagonists. The polypeptides of the invention may be employed in combination with a non-sterile or sterile carrier or carriers for use with cells, tissues or organisms, such as a pharmaceutical carrier suitable for administration to a subject. Such compositions comprise, for instance, a media additive or a therapeutically effective amount of a polypeptide of the invention and a pharmaceutically acceptable carrier or excipient. Such carriers may include, but are not limited to, saline, buffered saline, dextrose, water, glycerol, ethanol and combinations thereof. The formulation should suit the mode of administration. The invention further relates to diagnostic and pharmaceutical packs and kits comprising one or more containers filled with one or more of the ingredients of the aforementioned compositions of the invention.

Polypeptides and other compounds of the invention may be employed alone or in conjunction with other compounds, such as therapeutic compounds.

The pharmaceutical compositions may be administered in any effective, convenient manner including, for instance, administration by topical, oral, anal, vaginal, intravenous, intraperitoneal, intramuscular, subcutaneous, intranasal or intradermal routes among others.

In therapy or as a prophylactic, the active agent may be administered to an individual as an injectable composition, for example as a sterile aqueous dispersion, preferably isotonic.

Alternatively the composition may be formulated for topical application for example in the form of ointments, creams, lotions, eye ointments, eye drops, ear drops, mouthwash, impregnated dressings and sutures and aerosols, and may contain appropriate conventional additives, including, for example, preservatives, solvents to assist drug penetration, and emollients in ointments and creams. Such topical formulations may also contain compatible conventional carriers, for example cream or ointment bases, and ethanol or oleyl alcohol for lotions. Such carriers may constitute from about 1% to about 98% by weight of the formulation; more usually they will constitute up to about 80% by weight of the formulation.

For administration to mammals, and particularly humans, it is expected that the daily dosage level of the active agent will be from 0.01 mg/kg to 10 mg/kg, typically around 1 mg/kg. The physician in any event will determine the actual dosage which will be most suitable for an individual and will vary with the age, weight and response of the particular individual. The above dosages are exemplary of the average case. There can, of course, be individual instances where higher or lower dosage ranges are merited, and such are within the scope of this invention.

In-dwelling devices include surgical implants, prosthetic devices and catheters, i.e., devices that are introduced to the body of an individual and remain in position for an extended time. Such devices include, for example, artificial joints, heart valves, pacemakers, vascular grafts, vascular catheters, cerebrospinal fluid shunts, urinary catheters, continuous ambulatory peritoneal dialysis (CAPD) catheters.

The composition of the invention may be administered by injection to achieve a systemic effect against relevant bacteria shortly before insertion of an in-dwelling device. Treatment may be continued after surgery during the in-body time of the device. In addition, the composition could also be used to broaden perioperative cover for any surgical technique to prevent bacterial wound infections, especially *Staphylococcus aureus* wound infections.

Many orthopedic surgeons consider that humans with prosthetic joints should be considered for antibiotic prophylaxis before dental treatment that could produce a bacteremia. Late deep infection is a serious complication sometimes leading to loss of the prosthetic joint and is accompanied by significant morbidity and mortality. It may therefore be possible to extend the use of the active agent as a replacement for prophylactic antibiotics in this situation.

In addition to the therapy described above, the compositions of this invention may be used generally as a wound treatment agent to prevent adhesion of bacteria to matrix proteins exposed in wound tissue and for prophylactic use in dental treatment as an alternative to, or in conjunction with, antibiotic prophylaxis.

Alternatively, the composition of the invention may be used to bathe an indwelling device immediately before insertion. The active agent will preferably be present at a concentration of 1 μg/ml to 10 mg/ml for bathing of wounds or indwelling devices.

A vaccine composition is conveniently in injectable form. Conventional adjuvants may be employed to enhance the immune response. A suitable unit dose for vaccination is 0.5–5 microgram/kg of antigen, and such dose is preferably administered 1–3 times and with an interval of 1–3 weeks. With the indicated dose range, no adverse toxicological effects will be observed with the compounds of the invention which would preclude their administration to suitable individuals.

Each reference disclosed herein is incorporated by reference herein in its entirety. Any patent application to which this application claims priority is also incorporated by reference herein in its entirety.

TABLES

Certain pertinent data for each of the polypeptides and polynucleotides set forth in the Sequence Listing are summarized in the following Table.

TABLE 1

Provided in this Table is the closest homologue of each polypeptide encoded by each ORF of the invention based on a comparison of the sequences of in the Sequence Listing with sequences available in the public domain (see the right hand column entitled "Desc"). Where no significant homologue was detected "unknown" appears in the column. Preferred polypeptides encoded by the ORFs of the invention, particularly full length proteins either obtained using such ORFs or encoded entirely by such ORFs, are ones that have a biological function of the homologue listed, among other functions. The analysis used to determine each homologue listed in Table 1 was either BlastP, BlastX or MPSearch, each of which is well known. In the left hand column the SEQ ID NO: of each DNA sequence in the Sequence Listing appears. In the center column, the SEQ ID NO: of each protein (polypeptide) sequence of each sequence in the Sequence Listing appears across from the DNA sequence which encodes it (which DNA sequence is in the left hand column). In some instances the DNA sequence encodes more than one protein sequence and so is listed more than once, each listing being shown next to the encoded protein sequence.

TABLE 1

| DNA No.: | Protein No.: | Assembly ID | Description |
|---|---|---|---|
| 1. | 260. | 2698808 | Unknown |
| 2. | 261. | 2700024 | Unknown |
| 3. | 262. | 2700052 | Probable ABC Transporter |
| 4. | 263. | 2700068 | Unknown |
| 5. | 264. | 2700110 | Unknown |
| 6. | 265. | 2700242 | Polyribo-Nucleotide Nucleotidyl-Transferase (Ec 2.7.7.8) (Polynucleotide Phosphor Ylase) (Pnpase). - *Escherichia Coli*. |
| 7. | 266. | 2700302 | Unknown |
| 8. | 267. | 2700520 | Unknown |
| 9. | 268. | 2700548 | Unknown |
| 10. | 269. | 2700738 | Unknown |
| 11. | 270. | 2700754 | Unknown |
| 12. | 271. | 2701136 | Excinuclease ABC Subunit B (Dina Protein) (Fragment). - *Bacillus Subtilis*. |
| 13. | 272. | 2701728 | Unknown |
| 14. | 273. | 2702000 | Unknown |
| 15. | 274. | 2702042 | 2-Oxoglutarate Dehydrogenase E1 Component (Ec 1.2.4.2) (Alpha-Ketoglutarate De- Hydrogenase). - *Escherichia Coli*. |
| 16. | 275. | 2702062 | Unknown |
| 17. | 276. | 2702076 | Unknown |
| 18. | 277. | 2702336 | Unknown |

TABLE 1-continued

| DNA No.: | Protein No.: | Assembly ID | Description |
|---|---|---|---|
| 19. | 278. | 2702342 | Unknown |
| 20. | 279. | 2702482 | Ribonuclease P Protein Component (Ec 3.1.26.5) (Protein C5) (Rnase P). - *Bacillus Subtilis*. |
| 21. | 280. | 2702500 | Riboflavin Synthase Alpha Chain (Ec 2.5.1.9). - *Bacillus Subtilis*. |
| 22. | 281. | 2702520 | ECKBLTDH NCBI Gi: 41862 - *Escherichia Coli*. |
| 23. | 282. | 2702580 | Glucose Inhibited Division Protein B. - *Bacillus Subtilis*. |
| 24. | 283. | 2702648 | Unknown |
| 25. | 284. | 2702700 | Flagellar Hook-Associated Protein 1 (Hap1). - *Salmonella Typhimurium*. |
| 26. | 285. | 2702838 | Pyrimidine Nucleoside Transport Protein. - *Bacillus Subtilis*. |
| 27. | 286. | 2702934 | Protein Dfp. - *Escherichia Coli*. |
| 28. | 287. | 2703752 | Unknown |
| 29. | 288. | 2703916 | Diaminopimelate Decarboxylase (Ec 4.1.1.20) (Dap Decarboxylase). - *Bacillus Subtilis*. |
| 30. | 289. | 2704026 | Unknown |
| 31. | 290. | 2704028 | Unknown |
| 32. | 291. | 2704448 | Unknown |
| 33. | 292. | 2704502 | Unknown |
| 34. | 293. | 2704680 | Unknown |
| 34. | 294. | 2704680 | Unknown |
| 35. | 295. | 2704892 | Unknown |
| 36. | 296. | 2705066 | Unknown |
| 37. | 297. | 2705204 | Unknown |
| 38. | 298. | 2705378 | Unknown |
| 39. | 299. | 2705414 | Unknown |
| 40. | 300. | 2705440 | Methylated-DNA--Protein-Cysteine Methyltransferase (Dat1) Homolog - *Haemophilus Influenzae* (Strain Rd KW20) |
| 41. | 301. | 2705526 | Ornithine Carbamoyltransferase Chain I (Ec 2.1.3.3) (Otcase-1) (Fragment). - *Salmonella Typhimurium*. |
| 42. | 302. | 2705632 | Unknown |
| 43. | 303. | 2705646 | Unknown |
| 44. | 304. | 2705712 | Ribonucleoside-Diphosphate Reductase 2 Alpha Chain (Ec 1.17.4.1) (Ribonucleotid E Reductase 2). - *Salmonella Typhimurium*. |
| 45. | 305. | 2705740 | Unknown |
| 46. | 306. | 2705742 | Unknown |
| 47. | 307. | 2705876 | D-Lactate Dehydrogenase (Ec 1.1.1.28) (D-Ldh). - *Lactobacillus Plantarum*. |
| 48. | 308. | 2706108 | Unknown |
| 49. | 309. | 2706282 | Unknown |
| 50. | 310. | 2706344 | Unknown |
| 51. | 311. | 2706452 | Nickel-Binding Periplasmic Protein Precursor. - *Escherichia Coli*. |
| 52. | 312. | 2706548 | Stringent Response-Like Protein - *Streptococcus Equisimilis* |
| 53. | 313. | 2706730 | Unknown |
| 54. | 314. | 2706734 | Phosphate Regulatory Protein - *Rhizobium Meliloti* |
| 55. | 315. | 2706832 | Diphtheria Toxin Repressor (Iron-Dependent Diphtheria Tox Regulatory Element) (Tox Regulatory Factor). - *Corynebacterium Diphtheriae*. |
| 56. | 316. | 2706930 | Unknown |
| 57. | 317. | 2707190 | Unknown |
| 58. | 318. | 2707592 | Phosphpribosylaminoimidazole Carboxylase Catalytic Subunit (Ec 4.1.1.21) (Air C Arboxylase) (Airc). - *Bacillus Subtilis*. |
| 59. | 319. | 2707978 | Unknown |
| 60. | 320. | 2708140 | Unknown |
| 61. | 321. | 2708372 | Unknown |
| 62. | 322. | 2708478 | Unknown |
| 63. | 323. | 2708862 | Nitrite Reductase (Nad(P)H) (Ec 1.6.6.4). - *Escherichia Coli*. |
| 64. | 324. | 2709034 | Unknown |
| 65. | 325. | 2709098 | Unknown |
| 66. | 326. | 2709168 | Unknown |
| 67. | 327. | 2709352 | Unknown |
| 68. | 328. | 2709366 | Rep827 Protein - *Staphylococcus Sp*. |

TABLE 1-continued

| DNA No.: | Protein No.: | Assembly ID | Description |
|---|---|---|---|
| 69. | 329. | 2709474 | Unknown |
| 70. | 330. | 2709570 | Unknown |
| 70. | 331. | 2709570 | Unknown |
| 71. | 332. | 2709600 | Unknown |
| 72. | 333. | 2709642 | Unknown |
| 72. | 334. | 2709642 | Unknown |
| 73. | 335. | 2709736 | Unknown |
| 74. | 336. | 2709760 | Unknown |
| 75. | 337. | 2709766 | Unknown |
| 76. | 338. | 2709772 | Unknown |
| 77. | 339. | 2709790 | Unknown |
| 78. | 340. | 2709830 | Udp-N-Acetylmuramoylalanine--D-Glutamate Ligase (Ec 6.3.2.9) (Udp-N-Acetylmura Noyl-L-Alanyl-D-Glutamate Synthetase). - *Bacillus Subtilis*. |
| 79. | 341. | 2709848 | Unknown |
| 80. | 342. | 2709852 | Unknown |
| 81. | 343. | 2709888 | Unknown |
| 82. | 344. | 2709954 | Unknown |
| 83. | 345. | 2709992 | Unknown |
| 84. | 346. | 2709994 | Heat Shock Protein Hslu. - *Bacillus Subtilis*. |
| 85. | 347. | 2710014 | Tryptophan Synthase (Ec 4.2.1.20). - *Neurospora Crassa*. |
| 86. | 348. | 2710028 | Single-Strand Binding Protein (Ssb) (Helix-Destabilizing Protein). - *Bacillus Subtilis*. |
| 87. | 349. | 2710092 | Elongation Factor Tu (Ef-Tu). - *Bacillus Subtilis*. |
| 88. | 350. | 2710096 | Unknown |
| 89. | 351. | 2710272 | Unknown |
| 90. | 352. | 2710276 | Unknown |
| 91. | 353. | 2710330 | Unknown |
| 92. | 354. | 2943530 | Unknown |
| 93. | 355. | 2943556 | Unknown |
| 94. | 356. | 2943564 | Unknown |
| 95. | 357. | 2943624 | Possible Sodium-Dependent Phosphate Transporter |
| 96. | 358. | 2943704 | Unknown |
| 96. | 359. | 2943704 | Unknown |
| 97. | 360. | 2943710 | Anaerobic Ribonucleoside-Triphosphate Reductase (Ec 1.17.4.2). - *Escherichia Coli*. |
| 98. | 361. | 2943716 | Unknown |
| 99. | 362. | 2943742 | U00013 NCBI Gi: 466868NCBI Gi: - *Mycobacterium Leprae*. |
| 100. | 363. | 2943746 | Unknown |
| 101. | 364. | 2943774 | Unknown |
| 102. | 365. | 2943782 | Unknown |
| 103. | 366. | 2943806 | Unknown |
| 104. | 367. | 2943822 | Unknown |
| 105. | 368. | 2943834 | Unknown |
| 106. | 369. | 2943864 | Unknown |
| 107. | 370. | 2943956 | Unknown |
| 108. | 371. | 2943960 | Unknown |
| 108. | 372. | 2943960 | Unknown |
| 109. | 373. | 2944036 | Deoxyribose-Phosphate Aldolase (EC 4.1.2.4) - *Mycoplasma Hominis* (SGC3) |
| 110. | 374. | 2944044 | Unknown |
| 110. | 375. | 2944044 | Biotin Synthetase (Ec 2.8.1.-). - *Bacillus Sphaericus*. |
| 111. | 376. | 2944066 | Unknown |
| 112. | 377. | 2944114 | Unknown |
| 113. | 378. | 2944126 | Sirohem Synthase (Contains: Uroporphyrin-Iii C-Methyltransferase (Ec 2.1.1.107) (Urogen Iii Methylase) (Sumt) (Uroporphyrinogen Iii Methylase) / Precorrin-2 Oxidase (Ec 1 .-.-.-)/ Ferrochelatase (Ec 4.99.1.-)). - *Escherichia Coli*. |
| 114. | 379. | 2944146 | Mercuric Reductase (Ec 1.16.1.1) (Hg(Ii) Reductase). - *Staphylococcus Aureus*. |
| 115. | 380. | 2944210 | Unknown |
| 116. | 381. | 2944212 | Unknown |
| 117. | 382. | 2944262 | Regulatory Protein Pfor - *Clostridium Perfringens* |
| 118. | 383. | 2944264 | Replicative Dna Helicase (Ec 3.6.1.-). - *Bacillus Subtilis*. |
| 119. | 384. | 2944276 | Ribokinase (Rbsk) Homolog - *Haemophilus Influenzae* (Strain Rd KW20) |
| 120. | 385. | 2944306 | Dna-Invertase Hin. - *Salmonella Typhimurium*. |
| 121. | 386. | 2944308 | Unknown |
| 122. | 387. | 2944310 | Histidine Ammonia-Lyase (Ec 4.3.1.3) (Histidase). - *Bacillus Subtilis*. |
| 123. | 388. | 2944342 | Unknown |
| 124. | 389. | 2944344 | Primosomal Protein N' (Replication Factor Y). - *Escherichia Coli*. |
| 125. | 390. | 2944360 | Unknown |
| 126. | 391. | 2944364 | Unknown |
| 127. | 392. | 2944366 | Starvation Sensing Protein Rspb (Ec 1.1.1.). - *Escherichia Coli*. |
| 128. | 393. | 2944390 | Probable ABC Transporter |
| 128. | 394. | 2944390 | Atp-Binding Protein Abc. - *Escherichia Coli*. |
| 129. | 395. | 2944414 | Potassium-Transporting Atpase (Ec 3.6.1.36), A Chain (Atp Phosphohydrolase (Pot Assium-Transporting), A Chain). - *Escherichia Coli*. |
| 130. | 396. | 2944426 | Unknown |
| 131. | 397. | 2944434 | Unknown |
| 132. | 398. | 2944446 | Unknown |
| 133. | 399. | 2944452 | Unknown |
| 134. | 400. | 2944464 | Lipoprotein Nlpd Precursor. - *Escherichia Coli*. |
| 135. | 401. | 2944492 | Pts System, Galacticol-Specific Iia Component (Eiia-Gat) (Galacticol- Permease Iia Component) (Phosphotransferase Enzyme Ii, A Component) (Ec 2.7.1.69). - *Escherichia Coli*. |
| 136. | 402. | 2944508 | Unknown |
| 137. | 403. | 2944522 | 1-Phosphofructokinase (Fruk) Homolog - *Haemophilus Influenzae* (Strain Rd KW20) |
| 138. | 404. | 2944556 | Folylpolyglutamate Synthase (Ec 6.3.2.17) (Folylpoly-Gamma-Glutamate Synthetase) (Fpgs). - *Bacillus Subtilis*. |
| 139. | 405. | 2944576 | Lactam Utilization Protein (Lamb) Homolog - *Haemophilus Influenzae* (Strain Rd K W20) |
| 140. | 406. | 2944578 | Lactam Utilization Protein (Lamb) Homolog - *Haemophilus Influenzae* (Strain Rd K W20) |
| 141. | 407. | 2944584 | Possible Glutathione Peroxidase |
| 142 | 408. | 2944592 | BK5TATTP NCB - Bacteriophage BK5-T DNA. |
| 143. | 409. | 2944644 | Phosphoribosylformylglycinamidine Cyclo-Ligase (Ec 6.3.3.1) (Airs) (Phosphoribo Syl-Aminoimidazole Synthetase) (Air Synthase). - *Bacillus Subtilis*. |
| 144. | 410. | 2944648 | Unknown |
| 145. | 411. | 2944654 | Unknown |
| 146. | 412. | 2944658 | Indole-3-Glycerol Phosphate Synthase (Ec 4.1.1.48) (Igps). - *Lactococcus Lactis* (Subsp. Lactis) (*Streptococcus Lactis*). |
| 147. | 413. | 2944670 | Unknown |
| 148. | 414. | 2944694 | Unknown |
| 149. | 415. | 2944706 | Unknown |
| 150. | 416. | 2944720 | Unknown |
| 151. | 417. | 2944746 | Unknown |
| 152. | 418. | 2944760 | Unknown |
| 153. | 419. | 2944782 | Pts System, Sucrose-Specific Iiabc Component (Eiiabc-Scr) (Sucrose- Permease Ii Abc Component) (Phosphotransferase Enzyme Ii, Abc Component) (Ec 2.7.1.69) (E Ii-Scr). - *Streptococcus Mutans*. |
| 154. | 420. | 2944800 | Right Origin-Binding Protein. - *Escherichia Coli*. |
| 155. | 421. | 2944806 | Unknown |
| 156. | 422. | 2944808 | Unknown |
| 157. | 423. | 2944838 | Phospho-N-Acetylmuramoyl-Pentapeptide-Transferase (Ec 2.7.8.13). - *Bacillus Subtilis*. |

TABLE 1-continued

| DNA No.: | Protein No.: | Assembly ID | Description |
|---|---|---|---|
| 158. | 424. | 2944882 | Oligopeptide Transport Atp-Binding Protein Oppf. - *Lactococcus Lactis* (Subsp. L Actis) (*Streptococcus Lactis*). |
| 159. | 425. | 2944888 | Unknown |
| 159. | 426. | 2944888 | Unknown |
| 160. | 427. | 2944902 | Unknown |
| 161. | 428. | 2944930 | Unknown |
| 162. | 429. | 2944932 | Unknown |
| 163. | 430. | 2944936 | Unknown |
| 164. | 431. | 2944966 | 30s Ribosomal Protein S4 (Bs4). - *Bacillus Subtilis*. |
| 165. | 432. | 2944988 | Unknown |
| 166. | 433. | 2945022 | Unknown |
| 167. | 434. | 2945040 | Unknown |
| 168. | 435. | 2945060 | Unknown |
| 169. | 436. | 2945070 | Unknown |
| 170. | 437. | 2945078 | Isocitrate Dehydrogenase (Nadp) (Ec 1.1.1.42) (Oxalosuccinate Decarboxylase) (I Dh) (Nadp+-Specific Icdh) (Idp). - *Bacillus Subtilis*. |
| 171. | 438. | 2945082 | Unknown |
| 172. | 439. | 2945186 | Unknown |
| 173. | 440. | 2945250 | Unknown |
| 174. | 441. | 2945254 | Unknown |
| 175. | 442. | 2945260 | Unknown |
| 176. | 443. | 2945316 | Tagd Protein. - *Vibrio Cholerae*. |
| 177. | 444. | 2945338 | 4-Methyl-5-(Beta-Hydroxyethyl)Thiazole Monophosphate Synthesis Protein Thif - *Escherichia Coli*. |
| 178. | 445. | 2945378 | Pyrroline-5-Carboxylate Reductase (EC 1.5.1.2) - *Arabidopsis Thaliana* |
| 179. | 446. | 2945474 | Unknown |
| 180. | 447. | 2945520 | Unknown |
| 181. | 448. | 2945550 | Unknown |
| 182. | 449. | 2945580 | Nadh Dehydrogenase I Chain G (Ec 1.6.5.3). - *Escherichia Coli*. |
| 183. | 450. | 2945772 | Unknown |
| 184. | 451. | 2945780 | Signal Peptidase I S (Ec 3.4.21.89) (Spase I) (Leader Peptidase I). - *Bacillus Subtilis*. |
| 184. | 452. | 2945780 | Signal Peptidase I S (Ec 3.4.21.89) (Spase I) (Leader Peptidase I). - *Bacillus Subtilis*. |
| 185. | 453. | 2945792 | Fibronectin-Binding Protein Precursor (Fnbp). - *Staphylococcus Aureus*. |
| 186. | 454. | 2945794 | Unknown |
| 187. | 455. | 2945802 | Rod Shape-Determining Protein. - *Escherichia Coli*. |
| 188. | 456. | 3038342 | X-Pro Dipeptidase (EC 3.4.13.9) - *Lactobacillus Delbrueckii* |
| 189. | 457. | 3038352 | Unknown |
| 190. | 458. | 3038362 | Unknown |
| 191. | 459. | 3038372 | Unknown |
| 192. | 460. | 3038374 | Phosphotransferase System Enzyme II - *Staphylococcus Carnosus* |
| 193. | 461. | 3038406 | Unknown |
| 194. | 462. | 3038410 | Crtd Protein - *Rhodobacter Sphaeroides* |
| 195. | 463. | 3038424 | Tetrahydropteroyltriglutamate Methyltransferase (Mete) Homolog - *Haemophilus Influenzae* (Strain Rd KW20) |
| 196. | 464. | 3038426 | Unknown |
| 197. | 465. | 3038428 | Exopolysaccharide Production Protein Pss. - *Rhizobium Leguminosarum* (Biovar Pha Seoli). |
| 198. | 466. | 3038438 | Galacticol-1-Phosphate Dehydrogenase (Ec 1.1.1.-.). - *Escherichia Coli*. |
| 199. | 467. | 3038442 | Unknown |
| 200. | 468. | 3038450 | Excinuclease Abc Subunit C. - *Bacillus Subtilis*. |
| 201. | 469. | 3038458 | Nitrite Reductase (Nad(P)H) Small Subunit (Ec 1.6.6.4). - *Bacillus Subtilis*. |
| 202. | 470. | 3038474 | Unknown |
| 203. | 471. | 3038482 | Probable Imidazoleglycerol-Phosphate Dehydratase (Ec 4.2.1.19). - *Anabaena Sp.* (Strain Pcc 7120). |
| 204. | 472. | 3038492 | Unknown |
| 205. | 473. | 3038496 | SXSCRBA Sucrose Repressor - *Staphylococcus Xylosus*. |
| 206. | 474. | 3038498 | Nitrate Reductase Alpha Chain - *Bacillus Subtilis* (Fragment) |
| 206. | 475. | 3038498 | Nitrate Reductase Alpha Chain - *Bacillus Subtilis* (Fragment) |
| 207. | 476. | 3038504 | 3-Isopropylmalate Dehydratase (Ec 4.2.1.33) (*Isopropylmalate Isomerase*) (Alpha- Ipm Isomerase) (Ipmi). - *Lactococcus Lactis* (Subsp. Lactis) (*Streptococcus Lactis*). |
| 207. | 477. | 3038504 | 3-Isopropylmalate Dehydratase (Ec 4.2.1.33) (Isopropylmalate Isornerase) (Alpha- Ipm Isomerase) (Ipmi). - *Lactococcus Lactis* (Subsp. Lactis) (*Streptococcus Lactis*). |
| 208. | 478. | 3038510 | Unknown |
| 209. | 479. | 3038536 | Unknown |
| 210. | 480. | 3038538 | Unknown |
| 211. | 481. | 3038544 | Formate Dehydrogenase Alpha Chain (Ec 1.2.1.2). - *Methanobacterium Formicicum* |
| 212. | 482. | 3038550 | Peptide Transport System Permease Protein Sapb. - *Salmonella Typhimurium*. |
| 212. | 483. | 3038550 | Dipeptide Transport System Permease Protein Dppb. - *Bacillus Subtilis*. |
| 213. | 484. | 3038552 | Unknown |
| 214. | 485. | 3038578 | Unknown |
| 215. | 486. | 3038588 | Seca Protein - *Staphylococcus Carnosus* |
| 216. | 487. | 3038590 | Di-Tripeptide Transporter. - *Lactococcus Lactis* (Subsp. Lactis) (*Streptococcus Lactis*). |
| 217. | 488. | 3038594 | Histidinol Dehydrogenase (Ec 1.1.1.23) (Hdh). - *Lactococcus Lactis* (Subsp. Lact Is) (*Streptococcus Lactis*). |
| 218. | 489. | 3038596 | Histidinol Dehydrogenase (Ec 1.1.1.23) (Hdh). - *Escherichia Coli*. |
| 219. | 490. | 3038624 | Thiolase (EC 2.3.1.9) - *Clostridium Acetobutylicum* |
| 220. | 491. | 3038642 | Exou Protein - *Rhizobium Meliloti* |
| 221. | 492. | 3038658 | Unknown |
| 222. | 493. | 3038686 | Unknown |
| 223. | 494. | 3038692 | Unknown |
| 224. | 495. | 3038726 | Unknown |
| 225. | 496. | 3038746 | Unknown |
| 226. | 497. | 3038752 | Unknown |
| 227. | 498. | 3038764 | Unknown |
| 228. | 499. | 3038766 | Glucokinase Regulator Hornolog - *Haemophilus Influenzae* (Strain Rd KW20) |
| 229. | 500. | 3038772 | Unknown |
| 230. | 501. | 3038798 | Bile Acid-Coenzyme A Ligase (Ec 6.-.-.-). - *Eubacterium Sp.* (Strain Vpi 12708). |
| 231. | 502. | 3038810 | Probable Reductase |
| 232. | 503. | 3038816 | Unknown |
| 232. | 504. | 3038816 | Unknown |
| 233. | 505. | 3038848 | Unknown |
| 234. | 506. | 3038858 | 3-Dehydroquinate Synthase (Ec 4.6.1.3). - *Bacillus Subtilis*. |
| 235. | 507. | 3038872 | Unknown |
| 236. | 508. | 3038896 | Unknown |
| 237. | 509. | 3638902 | Unknown |
| 238. | 510. | 3038954 | Unknown |
| 239. | 511. | 3038956 | Unknown |
| 240. | 512. | 3038964 | P115 Protein Mycoplasma Hyorhinis (SGC3) |
| 241. | 513. | 3039072 | Pyruvate Oxidase (EC 1.2.3.3) Mutant With Pro 178 Replaced By Ser, Ser 188 Repl Aced By Asn, And Ala 458 Replaced By Val (P178s,S188n,A458v), Chain A - *Lacto Bacillus Plantarum* |
| 242. | 514. | 3039118 | Unknown |
| 243. | 515. | 3039122 | Unknown |
| 243. | 516. | 3039122 | Unknown |
| 244. | 517. | 3039124 | Unknown |
| 245. | 518. | 3039126 | Unknown |
| 246. | 519. | 3039132 | Glucose-Fructose Oxidoreductase (EC 1.-.-.-) Precursor - *Zyinomonas Mobilis* |
| 246. | 520. | 3039132 | Unknown |

TABLE 1-continued

| DNA No.: | Protein No.: | Assembly ID | Description |
|---|---|---|---|
| 247. | 521. | 3039156 | Putative Ornithine Carbamoyltransferase (Ec 2.1.3.3) (Otc) (Hypothetical Protein In Sagp 3'region) (Fragment). - *Streptococcus Pyogenes.* |
| 248. | 522. | 3039170 | Unknown |
| 249. | 523. | 3039172 | Carbamoyl-Phosphate Synthase, Pyrimidine-Specific, Large Chain (Ec 6.3.5.5) (Ca Rbamoyl-Phosphate Synthetase Ammonia Chain). - *Bacillus Subtilis.* |
| 250. | 524. | 3039176 | Acetoin(Diacetyl) Reductase (Ec 1.1.1.5) (Acetoin Dehydrogenase) (Ar). - Klebsi Ella Terrigena. |
| 251. | 525. | 3039182 | Formate Dehydrogenase Alpha Chain (Ec 1.2.1.2). - *Methanobacterium Formicicum.* |
| 252. | 526. | 3039200 | Uvr-402 Protein - *Streptococcus Pneumoniae* Plasmid Psb470 |
| 253. | 527. | 3039234 | Unknown |
| 254. | 528. | 3039244 | CDP-Ribitol Pyrophosphorylase - *Haemophilus Influenzae* |
| 255. | 529. | 3039246 | Unknown |
| 256. | 530. | 3039248 | Unknown |
| 257. | 531. | 3039254 | Unknown |
| 257. | 532. | 3039254 | Unknown |
| 258. | 533. | 3039264 | Unknown |
| 259. | 534. | 3039282 | Unknown |

EXAMPLE 1

Isolation of DNA Coding for a Novel Protein from S. Aureus WCUH 29

The polynucleotide having the DNA sequence given herein can be obtained from a library of clones of chromosomal DNA of *S. aureus* WCUH 29 in *E. coli*. Libraries may be prepared by routine methods, for example:
Methods 1 and 2

Total cellular DNA is isolated from *Staphylococcus aureus* strain WCUH29 (NCIMB 40771) according to standard procedures and size-fractionated by either of two methods.
Method 1

Total cellular DNA is mechanically sheared by passage through a needle in order to size-fractionate according to standard procedures. DNA fragments of up to 11 kbp in size are rendered blunt by treatment with exonuclease and DNA polymerase, and EcoRI linkers added. Fragments are ligated into the vector Lambda ZapII that has been cut with EcoRI, the library packaged by standard procedures and *E. coli* infected with the packaged library. The library is amplified by standard procedures.
Method 2

Total cellular DNA is partially hydrolysed with a combination of four restriction enzymes (RsaI, PalI, AluI and Bsh1235I) and size-fractionated according to standard procedures. EcoRI linkers are ligated to the DNA and the fragments then ligated into the vector Lambda ZapII that have been cut with EcoRI, the library packaged by standard procedures, and *E. coli* infected with the packaged library. The library is amplified by standard procedures.

EXAMPLE 2

The Determination of Expression During Infection of a Gene from Staphylococcus aureus WCUH29

Necrotic fatty tissue from a four day groin infection of *Staphylococcus aureus* WCUH29 in the mouse is efficiently disrupted and processed in the presence of chaotropic agents and RNAase inhibitor to provide a mixture of animal and bacterial RNA. The optimal conditions for disruption and processing to give stable preparations and high yields of bacterial RNA are followed by the use of hybridisation to a radiolabelled oligonucleotide specific to *Staphylococcus aureus* 16S RNA on Northern blots. The RNase free, DNase free, DNA and protein free preparations of RNA obtained are suitable for Reverse Transcription PCR (RT-PCR) using unique primer pairs designed from the sequence of each gene of *Staphylococcus aureus* WCUH29.

a) Isolation of Tissue Infected with *Staphylococcal aureus* WCUH29 from a Mouse Animal Model of Infection 10 ml. volumes of sterile nutrient broth (No.2 Oxoid) are seeded with isolated, individual colonies of *Staphylococcus aureus* WCUH29 from an agar culture plate.

The cultures are incubated aerobically (static culture) at 37 degrees C. for 16–20 hours . 4 week old mice (female,18 g–22 g, strain MF1) are each infected by subcutaneous injection of 0.5 ml. of this broth culture of Staphylococcus aureus WCUH29 (diluted in broth to approximately 108 cfu/ml.) into the anterior, right lower quadrant (groin area). Mice should be monitored regularly during the first 24 hours after infection, then daily until termination of study. Animals with signs of systemic infection, i.e. lethargy, ruffled appearance, isolation from group, should be monitored closely and if signs progress to moribundancy, the animal should be culled immediately.

Visible external signs of lesion development will be seen 24–48 h after infection. Examination of the abdomen of the animal will show the raised outline of the abscess beneath the skin. The localised lesion should remain in the right lower quadrant, but may occasionally spread to the left lower quadrant, and superiorly to the thorax. On occasions, the abscess may rupture through the overlying skin layers. The affected animal should be culled immediately and the tissues sampled if possible. Failure to cull the animal may result in the necrotic skin tissue overlying the abscess being sloughed off, exposing the abdominal muscle wall.

Approximately 96 h after infection, animals are killed using carbon dioxide asphyxiation. To minimise delay between death and tissue processing/storage, mice should be killed individually rather than in groups. The dead animal is placed onto its back and the fur swabbed liberally with 70% alcohol. An initial incision using scissors is made through the skin of the abdominal left lower quadrant, travelling superiorly up to, then across the thorax. The incision is completed by cutting inferiorly to the abdominal lower right quadrant. Care should be taken not to penetrate the abdominal wall. Holding the skin flap with forceps, the skin is gently pulled way from the abdomen. The exposed abscess, which covers the peritoneal wall but generally does not penetrate the muscle sheet completely, is excised, taking care not to puncture the viscera.

The abscess/muscle sheet and other infected tissue, such as the necrotic pads of fatty tissue in the abdominal lower right and left quadrants may require cutting in sections, prior to flash-freezing in liquid nitrogen, thereby allowing easier storage in plastic collecting vials.

b) Isolation of *Staphylococcus aureus* WCUH29 RNA from Infected Tissue Samples

4–6 infected tissue samples(each approx 0.5–0.7 g) in 2 ml screw-cap tubes are removed from −80° C. storage into a dry ice ethanol bath In a microbiological safety cabinet the samples are disrupted individually whilst the remaining samples are kept cold in the dry ice ethanol bath. To disrupt the bacteria within the tissue sample 1 ml of TRIzol Reagent (Gibco BRL, Life Technologies) is added followed by enough 0.1 mm zirconia/silica beads to almost fill the tube,the lid is replaced taking care not to get any beads into the screw thread so as to ensure a good seal and eliminate aerosol generation. The sample is then homogenised in a Mini-BeadBeater Type BX-4 (Biospec Products) Necrotic fatty tissue is treated for 100 seconds at 5000 rpm in order to achieve bacterial lysis. In vivo grown bacteria require longer treatment than in vitro grown S. aureus WCUH29 which are disrupted by a 30 second bead-beat.

After bead-beating the tubes are chilled on ice before opening in a fume-hood as heat generated during disruption may degrade the TRIzol and release cyanide.

200 microliters of chloroform is then added and the tubes shaken by hand for 15 seconds to ensure complete mixing. After 2–3 minutes at room temperature the tubes are spun down at 12,000×g, 4° C. for 15 minutes and RNA extraction is then continued according to the method given by the manufacturers of TRIzol Reagent i.e.:—The aqueous phase, approx 0.6 ml, is transferred to a sterile eppendorf tube and 0.5 ml of isopropanol is added. After 10 minutes at room temperature the samples are spun at 12,000×g, 4° C. for 10 minutes. The supernatant is removed and discarded then the RNA pellet is washed with 1 ml 75% ethanol. A brief vortex is used to mix the sample before centrifuging at 7,500×g, 4° C. for 5 minutes. The ethanol is removed and the RNA pellet dried under vacuum for no more than 5 minutes. Samples are then resuspended by repeated pipetting in 100 microliters of DEPC treated water, followed by 5–10 minutes at 55° C. Finally, after at least 1 minute on ice, 200 units of Rnasin (Promega) is added RNA preparations are stored at −80° C. for up to one month. For longer term storage the RNA precipitate can be stored at the wash stage of the protocol in 75% ethanol for at least one year at −20° C.

Quality of the RNA isolated is assessed by running samples on 1% agarose gels. 1×TBE gels stained with ethidium bromide are used to visualise total RNA yields. To demonstrate the isolation of bacterial RNA from the infected tissue 1×MOPS, 2.2M formaldehyde gels are run and vacuum blotted to Hybond-N (Amersham). The blot is then hybridised with a $^{32}$P labelled oligonucleotide probe specific to 16s rRNA of S. aureus (K. Greisen, et al., J. Clin. Microbiol. 32 335–351(1994)). An oligonucleotide selected from the group consisting of the polynucleotides of the Sequence Listing is used as a probe. The size of the hybridising band is compared to that of control RNA isolated from in vitro grown S. aureus WCUH29. Correct sized bacterial 16s rRNA bands can be detected in total RNA samples which show extensive degradation of the mammalian RNA when visualised on TBE gels.

c) The Removal of DNA from Staphylococcus aureus WCUH29 Derived RNA

DNA was removed from 73 microliter samples of RNA by a 15 minute treatment on ice with 3 units of DNaseI, amplification grade (Gibco BRL, Life Technologies) in the buffer supplied with the addition of 200 units of Rnasin (Promega) in a final volume of 90 microliters.

The DNase was inactivated and removed by treatment with TRIzol LS Reagent (Gibco BRL, Life Technologies) according to the manufacturers protocol. DNase treated RNA was resuspended in 73 microliters of DEPC treated water with the addition of Rnasin as described in Method 1.

d) The Preparation of cDNA from RNA Samples Derived from Infected Tissue 10 microliter samples of DNase treated RNA are reverse transcribed using a SuperScript Preamplification System for First Strand cDNA Synthesis kit (Gibco BRL, Life Technologies) according to the manufacturers instructions. 1 nanogram of random hexamers is used to prime each reaction. Controls without the addition of SuperScriptII reverse transcriptase are also run. Both +/−RT samples are treated with RNaseH before proceeding to the PCR reaction.

e) The Use of PCR to Determine the Presence of a Bacterial cDNA Species

PCR reactions are set up on ice in 0.2 ml tubes by adding the following components:

45 microliters PCR SUPERMIX (Gibco BRL, Life Technologies).

1 microliter 50 mM $MgCl_2$, to adjust final concentration to 2.5 mM.

1 microliter PCR primers(optimally 18–25 basepairs designed to possess similar annealing temperatures), each primer at 10 mM initial concentration.

2 microliters cDNA.

PCR reactions are run on a Perkin Elmer GeneAmp PCR System 9600 as follows:

5 minutes at 95° C., then 50 cycles of 30 seconds each at 94° C., 42° C. and 72° C. followed by 3 minutes at 72° C. and then a hold temperature of 4° C.

10 microliter aliquots are then run out on 1% 1×TBE gels stained with ethidium bromide with PCR product sizes estimated by comparison to a 100 bp DNA Ladder (Gibco BRL, Life Technologies).

RT/PCR controls may include +/− reverse transcriptase reactions, 16s rRNA primers or DNA specific primer pairs designed to produce PCR products from non-transcribed S. aureus WCUH29 genomic sequences.

To test the efficiency of the primer pairs they are used in DNA PCR with WCUH29 total DNA. PCR reactions are set up and run as described above using approx. 1 microgram of DNA in place of the cDNA and 35 cycles of PCR rather than 50.

Primer pairs which fail to give the predicted sized product in either DNA PCR or RT/PCR (approx 20%) are PCR failures and as such are uninformative. Of those which give the correct size product with DNA PCR three classes are distinguished in RT/PCR:

1. Genes which are not expressed in vivo reproducibly fail to give a product in RT/PCR.

2. Genes which are expressed in vivo reproducibly give the correct size product in RT/PCR and show a stronger signal in the +RT samples than in the −RT controls.

3. Genes which may be expressed in vivo give similar amounts of product in both +/−RT samples.

SEQUENCE LISTING (534 sequences)

SEQ ID NO: 1 - DNA (Genomic DNA), 396 bp; single-stranded, linear
gaattcctgataattatttngcgatataagtcgtcaacgtaccaatattatcaatagtcactttanatncatcacctggttggaaaaatttaggtggttgaatacctgnaccancgtctgagtggtgtaccagttgcaataatatctcccggatgnagtgcaacacatcatgacatcactactattacaacaacatatatcagaatcaagtcgccagngtnaccatcttgtctaatttcatngtgacctcntgtaacaatattcacatttccaggtaatggcagtncgtcttgagnaangatttaaggacccatnggntnanccnncagttaaactnngtggtaaaaatgcttgatcttgntcactgcgggctntgagatcaagtgatatcgtaaa

SEQ ID NO: 2 - DNA (Genomic DNA), 696 bp; single-stranded, linear
cccctctattgcttnnttgatacgtttctgttctttaaatccaagatataccgcaaacaacataacaagaatgaaacctattatttgaataggtattaatccataccataattcattgacacttttggcttttaacactgcagctacacgagccattggacctccccaaggtnccatgttcataatcgccgcgcttaatgctaatagtaaaatcaataaatatttattcatatttaacgctttatataaaggtaataatgcaggaatagaaagcaaaaatgttaccgcaccggccccatctaattgggctattgtgccaattaaagctgtcattgcacagacaatgacgacattgcctcgtgtcattaatattaagcgtttgacaagcggcttgaataaaccactatcgttcatgatgccaaagaaaataatggcanagataaacataataacaacgtngatgacntgatctaaccctttagcaaaaaatccaaccaaatctgncacactatatcctaaaatcattgcccctaagcaaggtatgattgtcatacctacanctggatttatcttnntgggcaatgagtaancctacaactgaaataataatnatgngccccatcactgtcaaccacatattatcactattcatttattttctccctccacttncaatacaatttacattcacccccc

SEQ ID NO: 3 - DNA (Genomic DNA), 588 bp; single-stranded, linear
cccttgncaattcatngggttttctgtttaatatttttcgggttctaancccaccatatcaagtgattcatctactcttttatcaatatctttttcttcccactttttcatttgtgccactttgtgcaaaaatttcctttgggcctcaaatggggnataattccaatctncctccaanacgtanccaatatcccaacgcatttcgtaatactggataatcacttattggtttatctttaaaataaatataaccttcacttaagtgaatgagtcgattaatcatttttaatgtcgtagtttttccacaacctgaaggtccaattagcacaaaaaattcaccctcattaatattgaaactaatgttatcgacagcaacatgtttgccataacgcttagttacatttttaaacttaatcactttgccacctctttttttctcatagcataaaaccgagattatatgtatgtattccctatttaaccacgtttattacaattttcaaatttaaatgatttatccttgaacttttttaacaaaataatgaataataggtaatctccagttaagaaatagtgttattttacctt

SEQ ID NO: 4 - DNA (Genomic DNA), 500 bp; single-stranded, linear
cgggcagnctttanaattatttnaatgatgattagcaatgcatatacgattaattcgattatggnttatatctnnattgattaantcacttatatttcacaagtgtgttgctttggagcgtcaacgatgctatcacatattacggcatatgaaattttatctgaaattcgnaaaaaattagctcaaaaattaatgcgcctccctttaggngtagtggaatctaagaaaataggtgaattaaaaaatatatttgncgataaggttgaaacaatagaattacctttagcacatatgattcctgaagttatnggaaacttacttgtggcagctgctatcttcttatacataatgntcatngattggcgtattggataggtgncttantagataacgataccaatntcaatttncgcttctaaaaaagtnatgtcttggattttaatgaganaatttgctggacaaantgaaatccaatttntntttttnatttgncgnaatgg

SEQ ID NO: 5 - DNA (Genomic DNA), 808 bp; single-stranded, linear
accctgttgtccccnggggtcaatagaccccgacatactttnnggcttctgaaaataaaatttcaggnncgcactttaaagatggacgtcgatgtcgactaatgtgatgacngcctttcatctttttaaaaantcattaatttcccttcttgtttaanacgtacatanaagaaatacgcatacggtactaataaaatagttgtatatgttgcgtgtgttaataataatacaccgattaattcaggaatgatgtttaagaagtaatttgggtgttttggtaattttatataatccagatttaataataggatggttaggtaaaatgaataattttaatgtccaaataccacctaaagttttaataaccataaataacatgatataagcaaagattaatataactaagccaataccatttgcaaagctaaatgtatctttattaataaatgcctctacaccagccaatacataaattaaaacgtgtgttattgctaaaaacttcgaatttttaacgccatattcaactgcaccgtctgcttttaattgttttgagtgantaatacatatctttaagctgacaagtctgatacagagaaagataagtaatatagatagantcatgatgtcctccgtcattatgtcatatgtataagcgttgattttgacaacataaagtattttatagataaaacttgtcacatactattaactatttattaattttagtacataaatatgtttctaagtatgtgtttatgttcagtattttggataatttaataattttaaggatattaagcgcttacag

SEQ ID NO: 6 - DNA (Genomic DNA), 806 bp; single-stranded, linear
cggaattcttattcatttataaaataatattcgtatgatttgatgttttaattagtccaccatttcgatttgtgctatgataatagtgttaagtaaacgaaataaggggttattaagttgaataactacaaaattggccaacatatcaaggtgcgtgtaactggtattcanccatacggtgcgtttgttgagacccctaatcatactgaaggactgattcatatatcagaaattatggatgactacgttcataatttgaagaaatttctatcagaaggacaaattgttaaagctaaaattntgtctatagatgatgaaggaaagcttaatctatcattaanggataatgattacttcaaaaattatgagcgtaagaaggaaaaacaatcagtattagatgaaatcagaggnacagaaaaatatgggtnncaaacacttaaaagaacgcttaccaatcttggataaaacaggcaaagcgagcaactcgaaacngactaaaggaacaagataaatccgnacccgaaaatcaaacaaagggtcttgaaatgaaagtttcttagactataaaagagattaggtatctattaaattttattagatactaatctctttttgtctacgataacgtaatatgattgattctatttacacgtacaaatggtttaaggtgacatatccattatctttgttagatagaatcgttgatttgcaatattgtatgtggatttgttttttttatttattttagaaatgagaactacaacttaaagtattaaacgaattgcaactatataaacagataattg

SEQ ID NO: 7 - DNA (Genomic DNA), 1033 bp; single-stranded, linear
ctacggcataccatgcgaaataattgttgattctaatgctacaatcggttgattgttctcccgtgcttgctgaacttctcgagaatactcaatatacttgtgtaaatttgccatttttataatcctccatatcgtgataaagttgctgttgatctaggttgtgcctaactgtatatttcgtttctatcgttttctntgcgttaaccataccagcaattaatatatctacagtagacatcccatttanccagctatatactactgcagcacagaatgaatcgcctgcacctgtaacatctttcacactatgtggatggcataactgacttgatgattcttcctcaccactncggataattaattcttncacgccatntgtcacaataacatttntacacctaaatcattccagcggttttagcagctatttntanatcaacaagtagattcttatttntaantttaagtatggttctggcncancttnantcggggataatccaatcaatagcatgtaatgaatcaggcatatttttcatttttggggaagaaaccgtggtgataactaatttgatttgatgtttcgtggtataggcacataagaagtttaatgcctctttgcctaaattcaaatcgacaataatgcacttagcctttttcaataagtgtgaacgcttaattaaaaattcaggcgtaatgtagtcanacacttccatatctgctaagccatatgtcatgtcgccttctttactaattaaagctgtatatgaacctgtactcgcattttcaaattgttgaacatgancccaaattcataaatggtgtggncaatcgttgaatcatttcccantcactatcttgtccactagcagataanaaagcgaccgtttcgccaagcctacctaagttctcagcaatatttcttgctacgccaccaatagagcgtgttgacgttacaggatttgatgtttctgcaactaaatctttatgcacataaaacttacgatctacattcgctgcgccaatacaaacg

SEQ ID NO: 8 - DNA (Genomic DNA), 1172 bp; single-stranded, linear
cttacacaacaagttgtcanaaattatttttatgataatgatcgnncatttactagaaaagtaaaagaattatttgtagctcatcgagttgaaaaacaatataataagaacgaaattttacgcttttatttaaataatatttactttggggataatcaatatacgcttgagggcgcagcaaaccattatgtggnacacccgtgaataaaaatagnacaacaatgtctcacatcacagnttnacaaagcgctattttagctagtaaagtcaatgcacctagcgtatataatntcaataatatgtcagagaatttcacgcaacgtgttaagcacgancttagaaaaaatgaagcaacaacatnatatcaatgacacacaatatcaacaggctatgtcacaactaaatcgctaaatactngcattcatgtgtaagatgcttggaactataatgtagaaggtttaattgaaatgtcataatgataaagttgaattgtttctgcttaataaattttacagatttgcttgtaatcacactntcattttaaaagatgatagtgtgattttttgttagcatcgaaaaatatttaaagttaaacatttgctataggaagtggcttattgaataataaaagagtattgtataaaacttgagaaagtaacggggtgatccagtgccgaagattactaaaatagaagttcaaaagaaaaacaaagaacgtcttaatctttttttagacgaacaatttgananggnnantgggtatagatatcgatacattagtcaaatttaatttaaaaaaagggcaacaacttgaagctgctgacatggnagaggttcaanagtatgatcattatcgcataggtttaaacaaagcaatccantatttatcatataaaaagagaactgaaaaagaagttattcaatatttacaanaagaagagatatcagagcaagcgatttctgangtgattgaatattgttatcgcgaaaagttantcgaccatcaagattatgcggaaagtttacnaaatacaangattcgcacgacagataatggacctananttnatcancaaaaactntttcaacctcgggtatngnaccacctatcattganatgtttacaganctttcttagngaacaacagnncttggttgatattcatccaaan

SEQ ID NO: 9 - DNA (Genomic DNA), 399 bp; single-stranded, linear
gaaggcttgtcgtcccatttaagcatcactccgtttgttttcgcttaaaatcccttgcatcgatgctaacaattgatcaacatctttaaattctttatagactgatgcaaatctaacatatgaaacttgatcaacatgcattaacaagttcataacgtgttcacctatatctcgtgaagacacttccgtatgaccntcatctcgtnattggcatncaaccttgnttgntatgtcttcaagttgttggatatctaactggtcggttctcacaagaacgcacaagtccaataagtattttntctcttgaaaactgntctcttgcgccatcttttnncacaactataagctgacttaacttcgatatgttcaaattgtagggggaaaccgtggttcccacaa

SEQ ID NO: 10 - DNA (Genomic DNA), 632 bp; single-stranded, linear
atttatatatagtaacaaaactaaattataaatgacaatatcatatttcgcaatcactgttagtaatttaaatatttttcaaaaacgacataatcatcagtttgttcgatttcaacgaaattactatttaaacataatggtttaaaatcattattctctccaaacagaatcatcgtaatcacattaaggttgtcatagttttttcttaagtaagttggcaattgtcgcagcgcacttgaaccaataccattaaagcgatatgatttatccacttcaatagcagcaatgttcatgcgttcaccaatctgctccaatgcgataaagccacctnttggcancagcatcataaanttaatgatatntacatnggccacttcttgaacgactttcttcctccaagcttttaatgacgaacattgtttngatcttaagtccaagtatttggccggtcctttgcattggtcctcttcttagtcgnttgattgaatgatccagacgtccgttggtccagattggncaatttccgantctactactgnntttgntgataaatcaggaatcaccctgacattttgggaatgaatcaatntttccnggccaattccaaacctggttttttccaataatcgntt

SEQ ID NO: 11 - DNA (Genomic DNA), 438 bp; single-stranded, linear
gatatacagcactcagaattttaatgacaattaatgcagcagttaacacgacaacgccattaaatgcttctttatgcttcatcactgattctcatgctttcttcaatgcacttaactaaaaacttcaaactatcaagccattgattttgtttcgttaaagtaattgtcattgcattattttgaacaccaaccttcattgttctacctaaaggttgtgttgctttgaacagcacttcgccatcaatattttcagtggcttttacagataaatgaatatcaattattttccctttatctttaatcaacgtgatacctgaatgtaatgcgtgtacttttatttccactatatcaagcaaacgtgctacttcaacaggntaatccaattaaacgatcaattanttcatctttantgtcgataattgggncaaattgttccag

SEQ ID NO: 12 - DNA (Genomic DNA), 522 bp; single-stranded, linear
taccaaagttcttctttagaggctggggaatatntccnaactacatcacgacgcactcgaaacggttcctcgttggaaaatcgatgtcatttcgtgtatattgcacatctacaagttttctaagtaattcacttctatccatttccataccaactcgaacacttactactaaatctttatattcttcaggattacctaaaccatatatacaacttacactagcaataataattacatcatcgcgttcaaataatgcacttgtagcagaatgtcgnagntgatcaatttcatcattgattgaggcatctttttcaataaaagtgtcagtagacggtacgtatgcctcaggttgataataatcatagtaacttacaaagtattccaccctgttttcaggaaaaaattctttaaactcactatataattgccctgctnatgttgtggtaggtgcgataattaacgttggtttcccaacttctttaataacattactcatccgncaatgttttccctcgnggcagg

SEQ ID NO: 13 - DNA (Genomic DNA), 520 bp; single-stranded, linear
atcgccacctgtaccatgcaacaatattagcgttggtgcacctttnttgtccttcacgaaaaatatgttccatcacaaatcctcctcattccaattaatcatgttaacgcttagtattaaatggtcttatttctgattctatatactctcttttattttctaaaaatggtggcaatgataaacctncacctaatgtttcatacggntcatcttccataaatcctggtccatctgntgaaatttctattaaaatatgccccacacgtgnatataatgcttcaaaatagaaacgattaacgatgcctgagttggttaatacctacctctttatattncgggtgcccacgcttcttatttgcatcaggatctttccacaacgaaatgacacatgatgtacctcaccataacttgagggnggttgntggcctnnatcatcttttattaagattactggncacattggcgncttcgcaacttcaaggtaatgcgacatatcttcaagcgcaataggtggcatacc

SEQ ID NO: 14 - DNA (Genomic DNA), 397 bp; single-stranded, linear
gaattccatcagtgcgacaactgaagtatttanaccaataatgtcatcgacactagttactattatcgtcttcttaccacttgtgtttgtatcaggttcagtaggcgaaatgtttagaccttttgcattggctattgcatttagtttattagcatcgttattagtgtcaattacactcgtnccagctttggcagcaacactatttaaaaaaggcgttaaacgtcgtaataaacaacatcaagaaggattaggtgttgttagtacaacttataaaaangtatngcattgggtcactaaatcataagtgggatnggtaattatattaagtacattaatttggggntgnaactattgtttttggggggaccnagactagncacttagcttttttccagaa

SEQ ID NO: 15 - DNA (Genomic DNA), 444 bp; single-stranded, linear
aaccatcttaccgatatcagtacagtacggcgtaggaacgggcatccagcggattagaggtggtgaaaccaacctggttgttgataacgatacgtaccgtaccgccaacttcataaccacgcgctttcgacatgttcagggtttcctgaaccacgccctgcccggtcactntggggtcaccgnggatggtgattggnagnactttgttgntgctcggntcatcaagtctgtccagacgggcacgaacagaaccgatanctaccnggcttacaatctcaangtgagacgggttaaacgccagngccaggtgnaccagggcgccatcggtctntaagtcagacgagaagcccatgtggtatttcacgtcacccntgccgaggtgttctntatgtttacccgggggaactccgtcgnaacaantctttgggggttttttaccccagc

SEQ ID NO: 16 - DNA (Genomic DNA), 387 bp; single-stranded, linear
gaattccgtggagggcaattttgggcttgcaataaacaatcatcaaaatattgttggtactataggtttgattagactagataataatatgtctgcacttaaaaaaatgtttgttgataaaggttataggaatttaaaaataggtaaaaaacttttagataaagttataatgacatgtaaagaacaaaatatcgatggnatntatttaggaacaatngataaatntatnagtgcacagtattnttatnctaataanggcttccgcgnaaattaagcgaggagatttaccaagnagctttcctaaatcagatgtagataataggttccattacagcaaantcnaaagattaantcgangcactgaataantgnnatgacanccctcag

SEQ ID NO: 17 - DNA (Genomic DNA), 417 bp; single-stranded, linear
gaattcctagaaggagaatttgttagtggtgttgcagaaaagcaatggttggaagaaaaaggttatgaagtagactttgaattaatggctgaaataaatccaacaagattatcattaagtgattggcttaaagtccaaaactataataagtaatgaatggggtgcaatcatgattcaatcaatgtggtttaatttgcatgtgcaagatttagaaaagagcgcacagttttataaagcgttaggatttaaaataaatagaaacccacaaatgttagataaaatggtcggtattcaaataggtcaaacaaccgcaattttaatagaaaacaagcattttcaaaatgtaagtcagcaaagccttaatactgaaccaaatgaagtgatgatttctctaggtgtgacacaatgagagttgac

SEQ ID NO: 18 - DNA (Genomic DNA), 341 bp; single-stranded, linear
gaattcctatatactactttgaaaaggtgtgagcttaatgacaacttttagtgaaaaagaaaaaattcaattactagcagatattgttgaactacaaactgaaaataataatgaaatagacgtttgtaattatttaaaagatttattcgacaagtacgatattaaatctgaaattttgaaagttaatgaacaccgcgccaatatcgttgcagaaatcggtaacggntcacctatactcgcattgagtggtcatatggatgttgttggatgcaggaaatcaagataattggacttatccccctttncaactcacagaaaaagctggcaaattatacggtccg

SEQ ID NO: 19 - DNA (Genomic DNA), 351 bp; single-stranded, linear
gaattcctcaggtataacacttcncatatctttacgagnaacttttcaaactagatacccctgcaccaaccaacgtccataatggttgatagtaatgatggtctgctgggtctataattgctattttctcttttaagttntgattttttcttaatagtcttgatgctacggtaacacctgctgtaccgccaccaataataacaatntgataatgcttattcatttnttccacatccttaaattattttaatgattctggaaaatcttgatagccttctctaatattcaccacattttcaaaacctntgctttccaatatacccactgcaattgaacttctaacacctgact

SEQ ID NO: 20 - DNA (Genomic DNA), 324 bp; single-stranded, linear
gaattccgtgttaagaaacaagattaaaagagcaatacgtgaaaatttcaaagtacataagtcgnatatattggncaaagatattattgntatagnaagacaggcagctaaagatatgacgactttacaaatacagnatagtcttgagcacgtncttaaaattggcaaagtttttaataaaaagattaagtaaggatagggtagggaatgaaaacattaacccctcaacgcatcccgaagtcttacctcagacaaacgttagactgaccctagggttaagacttggcccnagggntatnntaacttactttaaaatgttttcac

SEQ ID NO: 21 - DNA (Genomic DNA), 484 bp; single-stranded, linear
gaattcctattatcgaattgcatgctacccctcctaaaanccaaatgctcttaatttatctacagataattggtctttatctttatttaaaatattttcaacatatttaaacaaaacgtctgtttctaaatgtactttatctcctaattttgtggatgataaaatcgttgaacgcctcgtttctggaataagatgaatgtcaaaactgttatcatgcttatcaaataccgctagacttacaccatccacagtaatagaccttgcttaactaactgattattaatatgttggctacattgaatcgnaataattgtggcattggtgtttcatttatttgtgaantgtcctagtcactacatgaccgaggaaaaatgtccaccaaacctaccgntacactcatggaagntctaaattacttctgattggcgcttacanctgctaataggtttatttcaaggctttattacttgacaggaaagatgct

SEQ ID NO: 22 - DNA (Genomic DNA), 481 bp; single-stranded, linear
gaattccttactgtatgataaaggtattaccaaacaatacttaagggggattatatactgtggntcaatcattatatgagtttttagaggaaaatataaattatctaaaagaaaatggtntgtataatgaaatagatacaattgaaggtgcaaacggaccagaaatcaaaatcaatgggaaatcatacattaacttatcttcanataattatttaggactagcaacaaatgaagatntgagatcagctgcaaaagcagctattgatacacatggtgtaggtgcaggcgctgntcgcacaancaatggtacattagatttacacgacgaattagaagaaacactagcaaaatttannggaacagaagctgcaatagcttatcaagncaggatttanttggnnatatggctgctatntcagcttgtcaangaatnaaaatgatgctattttntcagatgagcttaatcatgcatcaattattg

SEQ ID NO: 23 - DNA (Genomic DNA), 459 bp; single-stranded, linear
gaattccgtgttaggtggtaacgttacagaaacacatacctttaaattgccagaagatgctggagagcgccagatgttcattattgataaaaaaagacagacgccgaaaaagtacccaagaaaaccagggacgcctaataagactcctttacttgaaaaataatgcataatcctttacaactaacataaaaggagcgaatggataatgaaaaaacctttttcaaaattatttggtttgaaaaacaaagatgacatcattggacatattgaagaaggatcgcaatagtaatgttgaatccattcaaattgaacgtatcgttcccaacccgttatcaacccaagacaggtgtttgaacccaaataaaattaaagaacttggtgaatcaaatacaatgaacatgggtttactacaaacctattgttggtaagaccgatgagaagatatgtttgaaattattg

SEQ ID NO: 24 - DNA (Genomic DNA), 440 bp; single-stranded, linear
gaattcccnaaagatacnatncnatttaaatggatatcattccaagaagctgtagataagaatcgggaacnaatgtctctgtttaatgaaattcttaagagtcatcaaaagactccantttttgatacatctagcttgcgacatacttcgaaaaaattatcaacaattttaaaaggggatttgtaaaatgaatattgaaaaaatcgaacaaataatcaaattagtgaaggaaaatgatgttaagaaatttaaatataaaaattttgangatgaaatagaaattgacttcactgactcgaatcatttggctgcacacaggtaatcaatcaantcaangtatgaacaataatgatttgacagcttcaanagcgaatgataactccgatgtntcgacaaattgattatcatgacattaantcaccantggnaggtacattctt

SEQ ID NO: 25 - DNA (Genomic DNA), 358 bp; single-stranded, linear
cccccgggctgccacggtaactgatgcctccgcggtactggcgacagattacaaaatctcgttcgataataatcagtggcaggtcacccgccttgccagcaataccacttttacggtgacgccggatgccaacggtaaagtggcatttgatggtctggagttgacgtttacaggaacgcctgccgttaacgacagcttcacgctgaaaccagtaagtgacgccatcgtcaacatggatgtattaatcaccgacgaagcgaaaatagcgatggcgagcgaagaagatgcgggtgatagcgataaccgcaacggtcaggccctgctggatcttgcaaagcaacagtaaaacggnnggcgg

SEQ ID NO: 26 - DNA (Genomic DNA), 480 bp; single-stranded, linear
gaattcctaccagacgtcgcaatggtctataatttcgctctagataatcttggaataatatcttttattgttaaatatacttctggttgtccaaacattgctgttgaaatagcaaagtaactttctaagcgccccattctcgttattttattaatagcgatacctacatatttgataataaatggtaataccttaatataattaaaaatgcctattaatacagaaatgaacactaatggcagtaacacatttaaaaagaacgtaaagccatttntattttgtatatctccaaaaacaaagtttatacctgctttactaacatttattaacccttccaaaaaatgagcctaatgcaggtaagattggttaaaccaatcgtggtgttcatccattaaattacaacaatccaacaactttggattaaattatcaattattaacngccntttttggaagtctatgtttttacggatcccaaaaa

SEQ ID NO: 27 - DNA (Genomic DNA), 545 bp; single-stranded, linear
gaattcctctttcacttctatgattttttttaacttcgaaacgtcaagttgtgcatcaggttctgctgttacttccattacataaccttgaatcgttcttggtccaaaaggtacaattacacgcacaccaggttggatgacagattcgagttgttcgggaattatataatcaaatttatagtcaacgctcttcgacgcgacatcgactatgactttcgctatcattattgccacctagtttctagttcatctaaaatttgtgcagctaatactactttttttcctttcttgatatttaccttttcattatttctaaaatgcattgtcaattcattatcatcagaactaaatccgatagacatatccccaacattatttgaaataatcacatctgcatttntcttgcgtaatttttgttgtgcataattttcaatatcttcagcctctgctgaaaggctattaatactgngatgtttatgtcacctaaatattaagaatgtcttcagacgtttaaaagatactgacaatcaccacctggtttttca

SEQ ID NO: 28 - DNA (Genomic DNA), 429 bp; single-stranded, linear
gaattcctnaccatccatagctgtgnacacaacatgatctttatcaatcatcataatgttgcaaagggatttctttnatcaaactcaggtgcatatgctcgnacttcttccatagttangggcaatttcgttggggttaaagggtgtgttggatgcccctctggnnccaagctctcagaataagttaactcatctgtcttatcactatcttttacatgttgtanccatgaaaaaaagttaatatcttgtggtaatctngaaaatttaaaactgtgacttattaatgtgtgtctgtgagacatgtgnttatatgtcacatctaaactatctcgactgtgtattanctccttcgnngtagtcgctctgannantagggatatcaanggtcatgactcaacacatctaacaacnccttcttaanggttatta

SEQ ID NO: 29 - DNA (Genomic DNA), 434 bp; single-stranded, linear
gaattcctaatgcanaaaanttccccgagtcacagtacaatttgccgtgcttcggnggattactttgtttatttttattgtgtancattaataatgagttgtcttaacgattgtcgctttataactacacgtgctgtgacatcttttaagaaaaacacagaaggcttgtgcatgtgattgtaattggatgncatagagtaatgatatgcaccagntgataatatagcaagatagtctccacgtgtgactgatgaaggtaatttagcgtcttttaataatgatatcaccagactcacataattttccagctatagntacactgacatctgcttctacatctcttatttaacaaagcaatgcttgatactgtgcggtcataaaggtgaaggttcttgatattgaatcactcatnccgcatcgagttgaacatattt

SEQ ID NO: 30 - DNA (Genomic DNA), 535 bp; single-stranded, linear
gaattcctacaaggattcaaaataaaatacaagtgttttgcgaatatttgttcgtataaaatcttgaaatcaaaacgcaaaaacgaacaaacgtgcttatatttttatcgataatacaattantttgttgttctaagccaatttaataatcttatgagcacatnattttgacttctgttctttaataaatttctagatttagacattttaaattgctcagttttaaattcaaagttattatcatagcctatatggactacaccatcatactctaatagaataattgctgatgacacattaaacaatttattaacaaattgcactgcatcttttaattgctgctcaataggtttattaatatcaacaaagttttcattggtgattaatcataccctttagaacatcggnttaaatccncttcttncaatcgatgatattaagcaccattagtaataccatcatttttacaaaagggtcangaattttcttnattacagcttggtcaattatgtgtcancttgaaccatarrdctns

SEQ ID NO: 31 - DNA (Genomic DNA), 376 bp; single-stranded, linear
gaattccgtcatttccaggaggatangaaataagaattgagttattaatcagtggttttatttttatattggcttcccttagcgattgtggttgatggttatttagctagaaaatggaatttagttacaaatatggggaaatttgtgggntccattagcggataaattattagntgcaagtgctttaattgtncttgtgcaactaggactaacaaattctgtagtagcaatcattattattgncagagaatntgccgtaactggtttacgtttactacaaattgaacaaggatntggtaagtgcagctggncaattaggtaaaattaacacagcagttactatgggtagcaaattacttgggtgggtattagggtg

SEQ ID NO: 32 - DNA (Genomic DNA), 518 bp; single-stranded, linear
gaattctcagttcatgttgtggngacactttaaacggnctgtgccagtagcgaccgagtcatttcaagaatgaccatttcacatttatattataacacttgtcgngcgtaactgtatagnttttcagnngtgtttaaagttaagttatctacttcgcgctttccttggcttaattgtgaaattacatattgcgctacgccagnttggttgggaatttggtaacctgttatatcacttntggtcaanncaattatttttaatttataatcactcatattatctacgtccactcnttttatctaaacaataaaaatgtgtttntctccccntaaataataacaatggcaggcttaataaaaacaatattaaatacaatttgctcttgtcaaaattgaaaacccccacataatattattttatttaagngtaagaggggggcaatcagggctccagcataatgttaatctttgtcgggtggggttccngtcttgggtngcccnagatgcccactctctagg

SEQ ID NO: 33 - DNA (Genomic DNA), 423 bp; single-stranded, linear
gaattccactagaagttncaacattacgcattttacatttcgtaagtggagacggtggcaagctaaagattcattatgaattatatcaagataatgaaaaaatgggttcttatcaatatgaaattaactatnaggagataggcgaatgaatattattgatcaagtgaaacaaacatnagtagaagaaattgnagcaagtattaacanagcaggattagnagntgagattcctgattttaaaantgaagttccnnnngnntncaaaaaatggagattatgctactaatattgcgatggtactgactaagattggaaagnngtnctccncnctgnnnattgctcangcggaangnttgnnnaccttagctccnggacaccngcacatgnaacacaactngacattgcctggccccacggcttcaa

SEQ ID NO: 34 - DNA (Genomic DNA), 943 bp; single-stranded, linear
aatgacaaaatattaatcaattggcgtattatacaagagtaatagacatataaaagtcgaatgtaactacgtgagtactgattttattctttgtaaattacaagcatttcatatcataaagtttgaaaagaggtatattgaagtggagaaaaacgaatatacagctaaatataatgaatatagtcaattattagacgctacttactcgcaagctgtagcataccttttaaataaatatggcgctgtaaccgatgattattataaggaaaaatcatacacgcgatttttaaatggagaaatcaaaagtatttcaaaaggaaaatacactagagctagcgaaggattatattgtcatcacataagcgaagacaaattccaaaacttatcttgacctaagattcatttccgaatttaagtactcatacaacgtcaaaagaaagaaaacttagtgtactgtgatcttatcgagcatttanttttacatgcaattattacaaaagaatccaatggcaattggggtgtgggctggattatgtcaaatgatcaaaccaacagtcattgattgggacattagcgaatatactccaaaaccagcatggatgcaagccaccaaagcacgtgcctatgtgcctagaatattagtagagaaactactcattannattgacgatatgttagaaggaatagaaatatatgatntccntgagtctagataaatgattaanggagatatatttcgtgntcgntgagattgtgntatagatagnntaacccnntaattaaatattattctatnaaatagaccacgcatncctatctataaacggacaacgtttataaatgagtttgcatggtcttgaattgtattaaatntcttnttgggttttaatagntcacttagngggtatgtcaacattctttngacagcttcacgtgtattttt

SEQ ID NO: 35 - DNA (Genomic DNA), 1119 bp; single-stranded, linear
cagatatacctgcactaatcaaagtttcaccaaaatttaaagctgtgtgatatatcacaaatccacaaaatcctaaaataaaaataacagggatatctcttagttcaggggtaggcaatttctttataattacgaacggcaagagaattattgttgctaaaattaaacgaaatgccgacaatgattctgcactaaaatcatttaacgcaatctttatcattggaaatgcagatccccacaatatgatagtaaataaatatgatagaaaagtagtgtctcgaagtttattcattaatatcatcactcctttaattatgtgtttctatattaaaaaatatgatttaaaatgagtacaaccaattgggaatggatttacctatccaattttaaaagggagggagaagatggctaaatattaagatattgctagtgacataagagataaaataatcacagggggattgggttttatggaatgaagatacctccacagaggcaggtggcgatacaaatacaacgtnaatagagtgacgattattaaaagtattggagttattagaggctgaaggatttactatactaaagtggggagtgggnacatatgttaatgactatttgaatgaagcacatattacaaataagtggtctgaaatgatgttatggtcctctcaacaaagaagtcagtatacggtgcaattaattaataaaattgagacagatgattcgtatatacatataagtaaaggtgaattgggtatatcgttaatgccacatattcaattgaaaaaagccatgtctaatacagccagtcatattgaagacttatcttgtgggttataataatggctatggttatatcaaggttaagagatattatccggntgaacgaattgtcaaagcaaggtattaaattgtaggtagaggaaaattgtaatggatcaactccaggcgcttttacaatgccanaccaacttnttatcttattggggtttntagggtcaaagatgccataataatttcggatacaaccatcatattttccactctacaaantgtttgnggaacaaatggaattttagacatattgatgtccccntattatcaaatttaatgaaatta

SEQ ID NO: 36 - DNA (Genomic DNA), 600 bp; single-stranded, linear
aagaaatgttctagagatttaggtatcgaagaacccaggattaagacgattaaaagagcnactatgatattaggattatcaacatatttactgctgtgtgcaagaagtacgtgcttggacaatttaaaccaggtatgactgcacctcaatgtgctggtatcattcatactgattttgancgtggatttatccgtgccggaagtaacaagttattgatgactatgtacaatatggcggcgaaagtggcgctaaagaagcgggcagacaccgattagaaggtaaagaatatattatgcaagatggcgatatcgttcatttcagatttaatgtataaacgatagagtgaagttaattaaatagtatatatgtagaagaggcggaatcaattgttcgcctcttttaattatgcgtataatttattaaaagaatggaatgattttactcgcgtaaataatatcttgagtgctgaaaaattgtttgccttcgccagtataagcaggctctaaaacaagattagcctttgcacaataaagccattcaggatgaatgccactattaagtatctcttggaattcgatatcaagcttatcgataccgtcg

SEQ ID NO: 37 - DNA (Genomic DNA), 479 bp; single-stranded, linear
gaattcgnaaatgttggctttggcgcaatgaagaagcaaccaccntctaaaagctaagttaancttatttgaacacatgatnncgantgcacgtacatcancagaacaaggaatgcttgtntctgcggnaacaatgctcanncanagtacgctacccacatttacgaaaaatacatcacgaagtcgttcatgatatgaaatgtagcagacacgagattcaccctntgtntccagctgacttcgcaagtcannnaaatgtgttaactctagcggaaatgaaaaggacaattcatgatatattggatttcagagatgaagatatttgggnttgttatttgggtactttggctgtgtctccangcttaanggatgatganggtcannngttactatcacgtntangaaatgcttacaatnnttacgantagaaatgacccggatggcgnggncngntaaattgtcaatgntttnaaaggtaa

SEQ ID NO: 38 - DNA (Genomic DNA), 733 bp; single-stranded, linear
gcgagcttagttcattttaaagtaaagagttttttgtatgtaaagtatattagtaaaacacagattacttgtctctgtgaaattaatacgtttatactaaaagatatagtctttctagaaaatctgttaattaattgtgaatttttagaaaatttattgaacagcaaaatatggattgttataatttaagttaaacaaattcttatacaatattattaggaggcaatcaccatgtcacaagcagttaaagttgaacgacgagaaacattaaaacaaaaaccaaatacatctcaactaggttgtgggtaaatattttactgattatatgttgagttatgattatgatgcagataaaggatggcatgatttgaagatagtaccttatgggcctattgaaatttcacctgctgcacaaggtgttcaattatggtcaatcggtattcgaaggattaaaagcatataaaagagatggggaaggttgcactttnccccnncccgaagaaaattttaagcgtcttaataactcgttagcacgattagaaatgcctcaagtagacgatgcagaattgttagaggggctaaaacanttagttgatatagaaagagatnggnttcctgaaggggaaggtcaatcattatatnttcgnccatttggtctngcaacagaaggggcactnggcgttggcgcatcacatcagtatnaaatttattaaattatnttatcttccttcag

SEQ ID NO: 39 - DNA (Genomic DNA), 1263 bp; single-stranded, linear
acttgtgcactgccaataataattaatcctttcatatttgacccctcttttttttattaaacttgttgttcacgtaataatttcataatagcttttccaacaccactattttcattcgtatctgtgacatatttcgctatttttttaacttcttctgcaccattttccatcgcaactggatagccaactttctctaacattgataagtcatttaaattgtcacctattggcatgacatctttcatttcaatccctaatctttcggcaattgtttctagcgcaatacctttnggtgcatctgaatgcgttatttctatatttcctctcgaagatgatgatatagctaaattcggagattcagctaaaattttactagcttnggcaattttttcttaaatttccatcaaatgctaatattttcataattaattcaacaggtatgttttcaataggatcataattatcaacaactttcaacggtnccaatatctatgcgtctttgnataccatcttnaatacgctcaacgtntggatgttgacctgcacgctcagcaatatctatgtaaatgtctaaatctcttgggggatcttccagtataaatcgcacgactcggntatnctggataataagtacctgnatcttttaaaacatntgtaatgnggtgtactaacgatttattanggngtgaagtgctcattacattgaaagtttcatcacgttcttcagnaccattcagacaaatatatggtactgntaaatctgtgtcagcaantggtgcttgtgcttcaaaaaatgctcgacctggcacgagcgataacaaccgttatcccttgttcttgagcgtattnantcgcatcaatattaggttgagaaatttcatntgctgcattaaggtagcgngccatccatatcagnggntattaggtttntcantatgttnccncgcccncgnctttcgtaaatttaaaatcttgttcttaaataagaatatatactcagcgcacatacttttctattaacatttatattgtcattaatttatcatataatgtaattctaacaaattttaattagtatgtactatcgtcttaattggtggatttcttattggctcttaagtttttaaaaaatgttggttaataatggtgctacatgcttcttttaaggtacaacctttatcaacaaattggacggatgattaaaaattaggttnggttggaaataaattcaattaaacttgctactacaaaccaccrrdctns

SEQ ID NO: 40 - DNA (Genomic DNA), 594 bp; single-stranded, linear
attatgcctatttgacacattattgaaatttttaatataccccttatacgttacggctttgtactgtgtttaggtatataaagctttgacatatcgatattctccaactctaacagcttaattttattattaatcgttccaccgaatcctgttaagctacccgttttaccgacaacacgatgacatggcacgataattgataatggattacttccgactgcacctccaaccgcttgggctgacatttgtggcttatcaagcaccttacctacttttgtggcaatagcaccatacgttgttagagtcccataaggaacctgtcttaattcattccaaacacactgttgaaaatgactacctgttggctttaaaggtattgtgatttcaggattgtcaacctttaaaatacgcgtcttaaccactgtgtcgnctctctaaatatcgctaaagacgtattttcttccctagtaccaacaccttgttgattttcaaacaaacagcggtcagattacccatcactcaaaagtccaatcgtctacagcgatcatagtactctatctccataaatcccccttttcttatcatacgcctatg

SEQ ID NO: 41 - DNA (Genomic DNA), 511 bp; single-stranded, linear
aatgggaagttcaatacccataatgncaagcacccttgcatttaattgcattttccnaccgttattacnggccccatctccaacaatatgtaaagttaatatctgcataatctttttttaaagacttcttttgctgttaagaaatcagcaagancttgagtaggatgatcttcatcagttaaaccattccacactggtacgcctgaatattcagctaaagtttctactgttctttgtgtnaaacccgcggtattcaatgccatcatacattccaccaagcacacgtgcagtatctttagttgtttcttttttacccatttgtgatccagttgggcctaaataagttacatttgcaccttgatcatgcgctgcaacttcaaatgcacatcgcgttcttgtagaatctttttcaaataacagtgcaatatttttattttttaacataggcttttcagtgccaatatatttagcacgttttaaatcctcggagagngttaataatnngnaattc

SEQ ID NO: 42 - DNA (Genomic DNA), 546 bp; single-stranded, linear
ctgccttttctctatctgataaaccacgctttattaaaattaaatctcctaaccataccccgtctaaattatctggaagtacatcagcctctcttacttcaatataatcatgttgtattaaagtttcttcatataatcccatctgatacatcctttacttacgtttacttcttatataatctgcataatctaaaactctttggcattcatcatctgtcaattctccttcaaggtgagctgcacgatgttgtacttcgntttctggttgtctatttnntaatagtaaatattctggggtaactttcaatgcattggcaatttcagctatatcctccataggtatttntctgctaccgnntncgtatcgggataaggtagatttattgacacctatcttaggtggaaaatcaggtaaattcacattatttncttttcggaggttgggtgattaatttanctatttccgctgaagtnctcatattcaaatttactcccgtttatttatacagtataataacacttcccatattaggaaacactagcatt

SEQ ID NO: 43 - DNA (Genomic DNA), 572 bp; single-stranded, linear
ttatattatgttctgttggacccagtaaaatgttgcaatgtatgataaaaagcccttggttcaattaatcgaaaatcgacaccaatcgtttcatcatcatacgctaattctaatgaaacttgtgtgttccccactgcaacttcttttactttattgggaatatttaataattgctgctgcactgcttgtgggttatcggtacttattatgaaatctaaatctttgctcatttctttaaaacgacggaagcttcctgcagatgaatattgatcgatataatttaatgtatctatataatcaatgatttcttgattaagtcttctcattggatcaattggatatctatctttcttagcacagnggggtttcacagcttctaatatggtgtggtccgntttctttagcaaatccgcttaattcacttaacttntcccaatntcacaancaacttggaagtgacgcttntatcaacaaatattccaactctttatatagcttagcaatttcttggttccaagtctggaantttcaaaagtggattaagacctcccggacttcttcccggtaatggt

SEQ ID NO: 44 - DNA (Genomic DNA), 1115 bp; single-stranded, linear
ggatgcactctgttagcattatctttaaacattaaatatggataacctgattgtaattgtgtntgcgcaattaaattcaacatttcacgcgcattctttttctttttctcaacatttgggtttgcaaccatgtcatcataatatttttctaaatcgatatcgtctaatgtcacaccatattcttctttaactgtatgaggtgcaaacatataaaagtccttaccttctttagctaaatcgaagaatttagatggaacaattaaaccagttgatattgtagataaacgtaaatcttcatccgcatttacttnnttagtatctaaaaattcttctacatcataatggaagatatttaaggtacacagcaccagcaccagggcggttggacaagttggatctgcatagctaaagccaccttcaagtgacttagcaataggtaaaacgccttncgctacgcctttaattcctttaattgcttcaccacgtgcacgcaatttagataagttaattgcaacgccgcccccaattttacttaattggtngngcaaggnggantcaataaagttaanttgaatttaagntgncaacccacttcttnnatnngaaacatgacactagctcaccacgacgcgcacggnctgcgtttaaaaatgttggtgtcgctggntgatatctttgttcaaccatagcagaaataaattgtttagcttgtgctttattaccatntgctaggtataaagcaacaatggcaacgtgttgattatagtcttctaagtattgacttttatcatttgtttncaaagcgtaatctttgaaaaatttactagctgacatataacttgcaaaattaaacgagattgattntggataatcagtgatttcaattagatccncttcactataaatatcaaacacattgaaataaaaatcggtgtcttctaaataacgtaaaacgctcgatttcaatattcgaagaagatngcgtgggctttttacttctttcttaaattaagcttacntaaaggttccttggggcttttttcttaaacttaaaggaatcccatcttcctcttcccggttnggggaccccaaatattttactcaaatattgatgg

SEQ ID NO: 45 - DNA (Genomic DNA), 1123 bp; single-stranded, linear
ttccatggaggcatgcgcacaatctgcattgtaattcataccaaaatgttcaccgactcccaaccgaatccaccgaaaatgccaacatctagaatcggttgcacatcatgttcaacacattcttcgtgcaataaattagagagttcattattgatgccataaccgatgctaattgtatcnccataagttaaaaactgagcagcacgtcggagaatcaatttccgactantaaaaggtaatgcgggttcaggtattccatcaattcgttcttctcaagacaaggctggtaaataatgactctgaattacttggcggtgattcttttcatcttctgtgacgaatacataatcgacaagatttcctgggataacaacttcattcggttttaggtgatagtcgtcaactaaagctttaacttgnacaataactttcccatgattggctttcgcgtttaatgcgacatgataacactcgctcaagtacgcttcttgagntaaataaatgttaccttgttgatctgcgtatgttcctctcagtagtgccacatcaacgctagggaatgtgtaatgtaagtatgtttcatcgttgatggttactaatgaaactaaatcatcagttgttcgtgtatttactttaccgccaccgtatctaggatcaacagctgtgtttaatccgattttagtaataactccaggtaataattgattactctgacgataatgagttgcaatgataccttgtggtaaaaaataagcttcaatgtcattatttttcattgcttgtgccgttttggaagaagccgttaaaatgctcataatgacacgtttaatcatgcgacgttctataaaatcatctaaatccggtgcggcacctaaactatggatatcattcgctaatataaacgttaaatctttgggcgtatgatatgtgtcatgttgcgctaacacagcacgtagaacttcggcgggtaagttggctacagctaatgctggtaaaccaatcacatcaccatctttaatgatatgttgtaagtcgtgccatgtgatttgtttcaagcaagtcacctccatcacatttgataaaatatagcgtttttacactttgtgtaaacccttacaagaag

SEQ ID NO: 46 - DNA (Genomic DNA), 960 bp; single-stranded, linear
ctccatttgcatttgggtctttaaaactaaacacatacttatagttgccattatgttcttcaatagaataatcattatacactttattattactaccaaatttatttgcttcattattagccgcatttaaagctgtttggaaatttggcaattgctgtaaagcttgagttttatttccattaaacggataaatttgacgtgcaaccggcgcggcattttgtccataatatggtgcaacgtaacttgattnttgattattacttgattgggttattatttgtttgggtnttgggtcattgtttgttgcatttggaattagattgttgctggttatcgtttgcactattatctttattatctttgnttacgtcttnactatcatcttnattgtctttcttatcttnagatgaatcanttgntttnttatcttgttgntcagttctcgctttatcatctttttctnnattactgtctttttggtggngcactatcttgaccacatgcagctnaaaataatgataatgctagtggaccctgtanctaatcttttcatacatatctcctcctataattcgatattcattgaataagcttgaaatacatatctnccatgtgtatcatttcatggcttgttaccanagacgtcaacattaatatgatttganttatcacaatacccataactacaatctaaggttctttttattataccctaatttttgttcattattatttaatttttgtgaattttatgttttctataaatttaattattttactttaacaattcattacgcatttagcatttcaaggcatacacaataggaattccgatgatttcattttatcttgctgcaaaaaacaatcattattacttcttttttccataattaaatcttgtatcccgttacatcacctggtntggaaatgatgttcaacccaaccacttttaaatccaag

SEQ ID NO: 47 - DNA (Genomic DNA), 1130 bp; single-stranded, linear
ttggccctttggagantccggattattgataaagatattcctagcgttcgctaagcatagttatgtgatgganaatagtcttgttgaagagttgttcaatattgcctcgnctgtcgctccaagtaatgataagcagggtgttttancgattatcgaacaagaagtattgnncaagtaggtagcacatcatcaatgaagcggctatcatgatacctaaatacatgttnnatgnaanctttgnataccgaatcatcnaacattaatatatctccaaacaggttagccaataatcccatagtaaaataagcccactacaatcagttgaatagatgataaaataaagcagattttaatcaanccgattttgatacagataaacaanatannaancaaaggcacatggtgcgcctgtgcttttaaatatatattaatttaaacgtgtttcacatgtacccaagttgttaatngacaagataattgctgcgtttaaancccaccttccaacaaggttttgtacctgcttcatcagagaagaaaccaatatgtggtgttactaaaattcctttcatgttccgattaactctaataatgttttatcgtcaatgtctttattagtccagtcatttgtgaagtatgcagcttcattttcataagtatcaatcgcagcacctaacaaagtaccatcgttcactgcagcgantaaatcaggtgtattgatgactgcaccacgtgctgcgttaactaagattgcaccttttttcacatgatcaaacattgctttatcgaataaatgatagctttctttgttcgctggaacatgtaaagaaataatatcggcatctttaatagcttctttaacactatctttataagttaaaaagtctaaatctttattaggataagcgtcataagctgtaattgtagcaccaaatcctgcatatattttagctgtagcagcaccgatacgacccgtaccgataattgcaacagtcatatttttaactggtttagacatgatttctgcttgccaagtaaaatcatgtgtttgtacacggcgttcaatatctgggaagcgacgcactaattgtagggcgatagaaacagaatactctgcagtgtttcaggggaag

SEQ ID NO: 48 - DNA (Genomic DNA), 573 bp; single-stranded, linear
gcagtatcaatagtagttggttcatcattgcccaacacctttttcaaattatcattttcaagttgaagcgctacattttcttctactaattcaactgcaagtgcctttaattctgaagtttcctttgaaagttgattgacattcatttctaaacgcattattttttcaaatatttcattgcgatccaaatgtaataatgcctccttaatgcatagtttctatttcttctaatttatattcaagtggctgttcatgtccctcaagcttcacctgcatagaaatgtctaatatatttaaagcaactactttcccggttaccatcaggcgtttcaattgcttcaccaatatcaggtaattgtgcacgtacttcctcataatagtcattttcatattttaaacaacacatcaagacgaccacatgcaaccagaaattttagttggatttaatgataaatttgggtcccttagccatctttaatcgatactgggttcaaaatccccctagaaaatgtaggaacaacataacgacctacccacaagggtcccgataccgccaagcaattgggcttcaat

SEQ ID NO: 49 - DNA (Genomic DNA), 870 bp; single-stranded, linear
ccttaagaagcacctttaccaattccgccaaaatctgtaaantcaaatgtagtaggtaatgtttttttaggttgaaccatttcttctaatttaagtagtcttgcatctgncacttcnacaatacccacatttgggtcnatagttgcgancggatagtttnctcccaaggcacccgcctttgtaattgcattaaataatgttgatttaccaacgtttggtaagccaacgatacctgctgttaaagccatgaatcattctcctatcttngtgtatcatcctgagatacgatgattttttttagttttttatcaaacgtttgacgtggaatcataatgcttcgttgacaattttcacacttaattctaatgtcagcacccattctaataattttaaaacgattggttccacacgcatgttgttttttcatttctactatatcatttattccatattgngacgccattaaatatgacctccatgtattataaactactaaacaccgntttcactatgattaaaaggtgtcattattggntgtggtgtcttgataccttcttgtaaaaacattttgtggacttctttacgaataatacgcgcaccagagaaaccntcacctggtattgtttctgctgaaacccntaatattactctagtatcttcaaaggcatcaataccaatcacaacaggatcacttacaaataaatnnatatttactacgcagaggatggtaaataatgtgtttaatttcttctcaacattatcaatattttcatctacagatactggaattttaacaattgctggttccactcggnaattgagtaantcggtattcaccccntnctactatttgggaagattggrrdctns

SEQ ID NO: 50 - DNA (Genomic DNA), 519 bp; single-stranded, linear
taagatattaagttataaaaatgatttgaaaaataaagtagaaaacttaaacaatttaagtccaactaatacnatgttgcgtggatatgcaattgttaataaaaaagacgaagtcattacgagtactaaagatttaacagaaaatgatcaattgacgttaacaatgaaagatggcttagtagatgcaaaagttacgaaagtaaggtgtaataatgactaaagaaacgcaaagttttgaagaaatgatgcaagaattagagcaaattgttcaaaaattagataatgaaacaggtatctttagaggaatcattagatttatatcaacgtgggtnttgaaactatcagcagcttggtgacacaacttttaaaaaatgccganaaaaaggngaatgacttaataaaagaagaagctgagattgttaaaaatgacgatcttccgantganttaattataganggangtcaatatgatntccggtggcgataattancccagnaatggttctcngtnggaaggag

SEQ ID NO: 51 - DNA (Genomic DNA), 734 bp; single-stranded, linear
ccaatcgcntgtntgactgtnttgtcactganagcgttatcttntttaccaganttgacaactnacattntcgtantcataggttgactacgcntaacttgatagtcacctgtatctttcaattgttttaaagagtctttgnctaagctatccgtacctctatcatctgtgagccanagtcgtttcaccttttttcattgataggaatgctgtttcaccagcaggcattacttttgcttgtactttgttaagttaagacttttcgccccagtattgatcatttttgttaaagtctgcagactcatcttttttgtgttcacctaatttaaatggaccagtaccatcgaactttttaacgccatcttttgttgtaccgtttttaaagtcttttggagacacaaatacatatggacgaggcatcgctaattcagccaatgcaggttgatatgcttctttcaaattcaattcaaccgtgtacttatctttaactttaacattgtcaattaatgttgaaatctttaaccaagaatgcaattttttattttgttganccgcatcaatatttttcttaactgcgtcagcatcaaatgttgntccatcatggaatctcacatcatctcttaaatggaattgtattaagtcttcccatcttcaagacacatcccattttttagctaggtaaaggcttaataccatctttcggtgttacggtacaaagcggctcgtarrdctns

SEQ ID NO: 52 - DNA (Genomic DNA), 1219 bp; single-stranded, linear
gngntncttatncgattcacagtgaagtaggtgataagatgattggtcccaagctgaaatccccaaaattgtgccaattgactatattttncaaacaggcgatattgttgaaatacgtactagtaaacattcatatggaccaagtcgtgattggttgaanattgttaaatcgtctagtgccaaaggtaaaattaaaagtttcttcncaanacaagatcgttcatctaatattgaaaaagcccgaatgatggttgaagttgaaataaaagaccaaggatttagagtcgaagatattttgacagagaaaaatattcaggttgttaatganaaatataactttncaaatgaagatgatttattcgcagctgtaggatttggcggcgtgacatccttacagattgttaataaattaactgaaagacaacgtattttagataaacaacgtgctttaaatgaagcacaagaagttacgaaatcattgcctattaaagacaacatcattactgatagtggtgtctatgtagaaggtttagaaaatgtacttatcaagttgncaaaatgttgtaatcctataccaggtgatgatattgtaggttatatcaccaaaggtcacggcacgaaagtacatcgcactgattgcccaaatattaagaacgaaactgaacgactaattaatgttgaatgggtaaaatcnaaagacgcaactcaaaaatatcaggttgatttagaggtaactgcgtatgaccgaaatggcttgttgaatgaagtactacaagctgttagctcgacagncggcaatttaattaaagtttcaggacgttcagatattgatnnnaatncaataataaatattagtgtcatggtgaaaaacgtgaatgatgtttatcgtgtggtagaaaagaccaaacaacttggtgatgtttatacaggtaacaagagtttgggaactagagggtccaaaaatattgaaagtaggtggtacaaaagaggttaaagaagcatcgggtggacgaattgatacattaaataatcaaatcaaaaaaaggatattggtttattagtcggggatccggncaagaactctacaagagcaaagatgcagatgtaattgcaaagaaaattgctaatgcaagattatttgaagatgacaataataaattaaactttaatatccaacaaatgaatggtgaaatactatcagtttcacaatttactctcg

SEQ ID NO: 53 - DNA (Genomic DNA), 498 bp; single-stranded, linear
actaaaatgattaaattacttatctcttttcatctgattgattatcgaaatttcttccttctaaacctgctaactcttctttagaagctgnaggtgctttcatttcaaatatctcattcactactgtgtaatcggaatatcctaatctggcaataggtttaatcgacttaatgtccaatttaccattatcaagaataaccntatcggcaatatgaacttgggcaactcttcctataacaatatctacggtagatactgggtctcctggcggaatacgaatcgggtgaacggtactcacatncaaaatgtactggcgatcttngactcgataaccngggggcttctatacaatgntncttncgggcacaaccggnatattnaaaatncaaccccccncaggtgggtaggtgccttccgacggataaattaacaggcttctctttaaatcatacggtggccatgtnccaatacaaacccaccccggtttcttcctggaat

SEQ ID NO: 54 - DNA (Genomic DNA), 922 bp; single-stranded, linear
ctgtcaatgaatatgatgatactgataaaattttctctaacccatcaaacaagaaaacagaagattatatttcaggaaggtttggttgatatataatggcaataattagacagcgatatcaggagcaacttgatgatttaataaaggaattacgtcggttaggtgcaaatgtctatgtgagtattgaaaatggtataaaatcattaagtattgacgatagaggctttgnacgacaaacagttaaaaacgataaacatatcaatcaattaaattatgatattaatgagcgagttatcatgttaattacaaagcaacagnccattgcgagtgatttgcgtatgatgatttcttcaantaaaaatcgnctccgatttagaaagaataggagataatgcatcgagtattgccaatattcgattgcgtacaaagattacagatgattatgtgttaacccgtttaaagacaatgggtaaattagctatgttaatgctaaaggacttagatcaagcatttaaaaagaaagataccgtattaataagagaaataattgagcgtgatgaagatatcgatgacttatatagtcatattattaacgcaacgtatcttattgataacgatccatttgtcgctgcacaagctcatttagcagcaagacatttagaacgtattggtgatcatattattaacatcgctgaaagtgtttatttttatttaacaggtacacattacgaacaaataacttaaagttattactataaaatcccttacgataaatatatatttctatcattcataaaccctcaaaaaaaaccaagattctcacaaattagnaatgngtgaaaancttngngntatattttggttcttacttattaaatnggtctcgcatcttaggntatttggnttggtcaatttcatcttg

SEQ ID NO: 55 - DNA (Genomic DNA), 1209 bp; single-stranded, linear
ccaatcggtcttatctttcaacacgtttgattgtancggatatcacccggttcataaatccnaaatcgttgtaatatatttctctttatattcattatttctaggaatccacccccnccgtgcgggcaagtttctgggaaatttaacagctatccagcctttcaacaaataaatctgaaattcgatgttctaaaatttctgcttcttgatgtacttcttcccaattatatttcaatatttctattaaaaataattctaatagtcgatgtctcttaatgatatcaagcgtatgcgttaaaccatcctctgttaatctaacacctttgtatggttttgtttcaacatagcctgctttttcaagacgtcctaccatttcacttacagatggaggcttaatatttaaaaattgagataagattttatttgtcacaaagtttttatcgccattaattcgtaaggatttgcctttaaaataagtcctctttttcttcagntaacatactttcacctcaacagacattgtctatattatatcacgaatttacttgacatgataaatattctcagtttattanacaattaattaggttagcctaaacttttaattaggaggtataaacgtttgttagaaacanaagatttaaatctgtttttaggtaataagcatgtacttaaaaacatttccttatcgataccagcacgagcggcgaaataattggtatcatgggcccgaatggtgctggtaaatcttcccttatcaagtctttaattggtgaatttaatgctaccggtactaaatngttntataacaaacctatacaacaacaacngcaacagattacatatattccacaaaaagcacatattgatttagattttcctataagtgtggaacaagtgattttatcaggttgctacaaagaaattggatggtttagacgacctaataaatcagcaagggattaaactcaaacagttattaagcgatttagaattagaatcttttacgtcatcgacaaaatttcaagaattaagtgggtgggacaaattacaacggtggtgcttangtaggaaagagcattggatggtcccgaaaagtgaaggtttattttctttagatngagcccggttggtcgggaatttggattttagggtagcgaaaaaattaatcaatgacaaaaaatccgagaactttaaaacaacaaagga

SEQ ID NO: 56 - DNA (Genomic DNA), 369 bp; single-stranded, linear
gaattcatnttatctatcggnaatcattngtaatacatctactaattatagtgttttattcgataatataactgcatgtacatctanagaagcctcttgcctngaaatcgcaccgtcaaacttaaaactataacctattaaatctgcttgngtgncattaccactcacagnacagcgattaaatgatgcagtagcaaccaaatcgtttcatgcacttncacataantacgactgacattangctgtgtagatgtacctgcttctanctcgccaagaacatcttggantncgngntngctatttggngcaatgtcancttcatccatngagcgctcaatagtgtcagctgccagagcggcataactgctt

SEQ ID NO: 57 - DNA (Genomic DNA), 268 bp; single-stranded, linear
ccttattataaattaaagaaaggtagtggtttctatgaaatacaatactaatgttaaacatacaactttagaagcgtttgtcacaactgtcaatgatttgggtattgaattaattatcaatgaagcacttcgagaggtaagaaaacgacagctcatagaacttatagatgacgcactcgtcaataaagatgaagcagcatttaatcaatatacggcagaatacaaaaatttggaggcatttctcggtgnataacattgattcgaattc

SEQ ID NO: 58 - DNA (Genomic DNA), 512 bp; single-stranded, linear
ctatacaactaaagtaattcacaattcaaacttttgaaagggtgtacaaagtgaaagtagcagtcattatgggcagttcttccgattggaaaattatgcaagagagttgtaacatgttggattatttggaaattccgtacgaaaaacaagtagtatccgcacatcgtacgccaaaaatgatggttcaatttgcttctgaagcgagagaaagaggtataaacattatcattgcaggcgctggcggtgcggnacatttaccaggtatggttgcatcattaacgacgctaccagttattggtgtgccgattgaaacanaaaagtttaaagggtattagattcttttattatcaattgctcaaaatgncaggagggtattccngntggaacgacttgcaantgggtgcagnagggtgcttaaaaacgcaggtattcttggcaggaagaatgttaagtnttcaaaantcctcttttggnngganaanttaatcaagnttgatcttccgnaatcaaaa

SEQ ID NO: 59 - DNA (Genomic DNA), 321 bp; single-stranded, linear
gaattccccaagttcctcgcatttaattgaactttataatatttgtagtcatccacaagcaaatatatacactcccaaaggtttacataattccaaattagacacacaacggtggattgaaaaatggcaaaaccattggcaacaatatcaatttggttactttgtattggtgaaaaaaatagattgtagtgntattggtatttgtggatatgaatatcgacaattaaagcaagaaacagnactaantttatttnataaattacatccaagttttggnggacaaggggtacgcatgtgaggctnttacagcaatcacaaatt

SEQ ID NO: 60 - DNA (Genomic DNA), 422 bp; single-stranded, linear
ggcacgactcgtgccgctcctgcacaagatgtaggagcatttttatatttaaataactagagtaattaacgtaaaggcgtgtgatacagtgaaaacaattgattaaattaacaccgaagcaagaaaagtttgtgctaggactcatagagggcaagagccaacggaaagcatatattgacgcagggtattcgactaaaggtaaaagtgataattatattgatagccgagcttttgagttgagtaagaatagtgcgggtttagataggtatgaagaattgcgtcaagaagcaggttgaacaatcaaaatggacacgccaaaagggttttgaagaatatgagtgggtaaagaatgtngctaagaattgacattgnaatagaggggaggtaaaggaaagggacaggttgatgcattcccccctagt

SEQ ID NO: 61 - DNA (Genomic DNA), 395 bp; single-stranded, linear
ggcccgagcgggacttaaaaaggccaccactggttgtgacctanccttatttacntttataaatataaggaggaggtagtagtgaaagacttattgcaagcacagcaaaagcttataccggatctcatagataaaatgtataaacgtttctctattcttactactatctcaaaaaatcagcctgtcggacgtcgaagtttaagcgaacatatggatatgactgaacgtgtactgcgctctgaaacagatatgcttaagaaacaagatgtgataaaagttaagcctaccggaatggaaattacagctgaaggtgagcaactgatttcgcaattgaaaggttactgngatatctatggagatgataatcgtcttgtcaagaagggtatttaaagaat

SEQ ID NO: 62 - DNA (Genomic DNA), 1493 bp; single-stranded, linear
ctgtgatttatcattcgattgcatgattagagggagggattaaacgtgacatatcatgagcgtgttttagcattaagagcaganagtaanagnnccgcatttgattttcgattcggnagatttatttaccnaagaagaatggctaagtatgtctcttgcagaaagacncaaagctganaaagcatttcgacacgnagttaaaaatatggacgatgtaagaatgcccttctcaagtgtccatgacgccccaagtaaaattatataatgttgtatattctgatancggcattaaacgtaattttaaacnagctgaaaatgaaggattctaatatcatttcgtttatatatagcagacatgatagaattttatatgtaaatcttgtaggtaatcgttttnnaaataatataagtatgactaaanccacatccaatataggacggggcttttagtatcgttccagatttgtggggagttagggtttacttaattaaaggggtctgccctcaattgctcaccaacgagggcaagttacatcaatcacacttcaattgccgccgactaggggtagtaatcattggcaataagaactagttagtgactaacggatttacgttccataagcaaagtgatacaaacgctcagcatcaatgtaaggcatagaatcaatagttaggtaaccatctttgatgtcaccaattaatccttgatttacaccagtgttcacgtaaatatcatagctacttacgtctgagaaaataagcgcttcaatctcttttctcataatcatcactccaatgtttatatattatttatataaactctctcgtctctctctatttattaacttcttacaagtctaatattacatgaatttccaaataaataaagaggtttgtgatgtatttcacaaatttatcactattttggaaaattaagaaatagttaattatataaaagtttaataagtcagaaaatatgataaaatgtagatgttctttagacattaaaagcttctaacatgatacggaatatgaggttcctgtatcacattagaagcttttttgttgcggtgcttatattaataatggcatgaatgaacgcatgctgtcttagtttcaggaatcggctagaatattaaacttccgttctttgaatatttnttaatttcttactaatatcatccagttcattcttcgcctttttaacccaatctccttgagctacattatcaaattcacctttaaattttttganatggctacctatatttcacagctcactttagatatcgaacttgtttcttcagagttacttgttatattaccaggttttatttgatattcagtttgactcataacttgtatcctcacttgaagtatagtgtacagaatctgtaaaataaatgttttcttctttattttctacaaaggtaaattctagattttttgaccctacagatgagccttttaaatcaccatcnccttttattaag

SEQ ID NO: 63 - DNA (Genomic DNA), 1215 bp; single-stranded, linear
tgatgtgatccaaccaagtgatagcaatgtatatgcagttggagaatgtgcagaacataccgccaaagtttatggactcgttgcaccactatatgaacaaggtaaagtaaagctgatcatttaacaaataaagaaacgaacggatacaagggatcaacaacaaattacgtcattaaaagtttctggttgtgacttgtatagtgctggtcaaagttgtagaaaatgcagaaattaaaggtattgaaatatttaatagtgttgataataacaataaaaaaatctttttaaaagacggtaatgtagttggtgcagtatcgtgccaatatggtgatatcgatgatggttcacgcttttataacatgatgaaaaaaggtgaatccactgaagattacacacttgtatcattgcttactaaaggtggagaagaggcatcgctatcaattgctgatatggctgatgatgaaacaatttgtggttgtaatggtgttgataaaggtactatagtaaatgcgattacggaaaatggctttacaacagttgaagaagtaacggctaaaacaaaagcggggaattcatgtggtaaatgtaaaccgcaaattgctcaaatattgcagcacaccttaggagatgactttgttgccgcaaaacctgctggtatatgtggttgtactgatttgacacgcgatcaaattgtaacgcaaataagagcgaaaggtttaaaaacatctaaagaagttcgacatgttttaaactttaaaaataaaggtggatgtccaaaatgtcgaccagcaatcaactattatttaaacatggtttatccacatgatcatgaagatgaaagagaatcaagatttgctaacgaacgttaccatgcgaatattcaaaatgatggtacattttctgttatacctcaaatgcgtggaggtgttacagatgcagaccaactgattcgtctaggagaagtggctaagaaatatcatgtgccactagttaaagtgacaggttcgcaacgtgttggtttgtatggaggttaaaaaagaagaattaccaaatatatgggaagactaggtatgcgttcagcatcagcttatggtaagaaaacacgctcaagttaaaagctgtgttgggtaaagagtttgggcgattgggtacgcaatacaacgacaacgacttgggatccgtttagaaaaacatttgggttcaatcgatcaaccc

SEQ ID NO: 64 - DNA (Genomic DNA), 760 bp; single-stranded, linear
ttacctccaaaatccttttaaatccatgcccatagaagatganncccaaaatacattanctaaatcgaaacattgccatccataactaccgtcgaaatcccatcctctattctctaatgttctcaaataanttaatgtactgctattactattacttttattatttgaagacactgtttntggtnttggttctactaatggtgtcattggcacttttaantnttgaccaanaaatantaaattaggatttgctatattatttgtattttgaatatttgaaactgaagtttngtacttttaatgcnatagcactaagtgtgtctcctttttttacagtatagagttgtgtttttggagcttctctaaacctgtagtaaccaaagtaattagtaagtaacnttaatcgttttcttctgataagaatntttgagcttccaagtttgcaatnttaanttcttnagtaggtncattgttanttaataactagattgttaccntggcttgagtttttcggagtatttgaaatctttatatcttgattaatttcatttccgtttgaaattgctgatttgttgtctaactttaaacttgtgtccgatgttttaacagcaccttcattttttattttgtcttttgtcgtatttttattagcatttaactctgatttcgctcgaatacattttgctcataccctcttgtaaaatctttagatttatcaatttcatctgcatatgcttngttcgacatacccaatgccaag

SEQ ID NO: 65 - DNA (Genomic DNA), 846 bp; single-stranded, linear
atatgctgaaaatgtatcatcaggattcaagatatcaattaaatgatgtggaataccatccatttcttcaggtgttacttgtgcagttccaatattcatatgtttgtaaacttgcatagaatcaccgcttatgatttcaccattgatacgcttcgcgagttctatgctaagctctgttttacctgaagcagttggccccacaattactacaataaaaggcttatttttattcatatttaattccactttctttattttttataaaattgattcaaccatttaaacaagtcttcccaaattgtgtcatgatcttttttcaaataacacttcatgacgtttatgatgataaagattcacttttaacaatttttaatgccagcttctctatatatattcgccaattttaaaatccctttaccataatcacctaaagaatcggcatatcctgaaactaataatataggcatggcatgatttaacattttcatattttttaattgtgatgtatgtagcatataataggctgtgtgatataataattgatntgacacattaaatccactatatggatctttaataaagttatctacttcaattggattactagaaatccaatcactntgtgtacgtaatggacgtatttttttattaaaactatntgatactaactggttaacccatncaactcgtttctcagcaccataaatttgtgtaatcagttgtaacactttaacggttgggtaaacctttccataattgaatacataccaaggtcaccactttaaaattagaccatcaacatatttgcggatattggtttcttacaaaacaatcttagttatacgg

SEQ ID NO: 66 - DNA (Genomic DNA), 2854 bp; single-stranded, linear
aagntgaatttttagtacaatttccactgtatttatctgttanccactttatacccgcaatatttcgttgatcttatataaacacttttggctgcttttccttgaccnaggntaanattanagattttcctttgtaagagtgtgttttgtagtatcataaatatgtaanctgtatnaaantccaccacattttaggacctggtganagatgtcgnaaaagaanattttaatattanctagtattatgttaatcatantaattagtgttgcaagtatcnantttaaaatgaaatatgacgaaaaagaaaaccaaaaatcaatttattataaagaacaacaancgcgcattacactttatcttaagcataatactatagaaccgaacacaaccaantctgnacatttcncnaaattggaancaantcctatgggaagtgctgtgattgaaggttacataaatganaataaagaagatgattttgttgcctatgcatcacctgaaaataactttcaatttgtaggtgatttanttnnaaagtgaaagattaagtgagttactaaaaccagcgcatcaattnnaacatcnccagatgatatnnnnnaagaactaaatannaagtagagtcactaangttaggagttactttaatgaacaaaaaacatgtttttgtaattattggtgtcattttatgtatatgtatagttgcatcagtcatttatttaaaagtgaaatatgacgaaaaagaaaaaccaaaaagcaaaatactataaagaacaacaggagcgtattacactctatctccagcataataccaaagaacccaataccatcaaatctgtgcatttcacaagtttaaaaagaggacccatgggcgatgccgtaattgaaggctacatcaatgaaancaaaaaagataattttactgcttatgctacaccagaacataattatcagtttggtggtgctatgatagaaagtgaaagattaagtgagttactaaaaccagcgcatcaattaaaatcacctgacgaaatcaaagaagaattagacaccnaagaaggccactagggtcttctttatttttgatttaatcttccaataatctatgtcattgctatcgaaggtgtttcgcaattaatatcaatcacttcatcatcaccaatacttccccagttttgtacagtacattaacacaagcgaaccccattaatgtaaatgaaataatagtttagccattataaaaacattatataccgaataacaatggcgaggacgtgatttattgacnactatcaaattttctcanatgtgtgtgattttttataannnagggtagagcaaggtataatatcctttcaatcggttttcatattttatatattttttaaatataagcgctaaatgttttaactaaagcatagattgacaagatgttatacagaattttaaattctatccaatattgttcgaagtgtagtatcactggantggtattaaacaatgtaaaggagagattgcanatgccgtataattacaagaaacacaatggagagttaatgtctgtaatgagccaaggtgaaaagtttattcatccaatccaccggtgaatgatgaacttagtgcattgattaaagctattaatctccaacaaattaacggttgtcattattgtgttgatanccanaanaaagaagtaaaggaantgggtgtaacacaactgannattgatgaagtcttganntttagacatttaganttatttacttgatcaagaaaaagtgacgcttgaagttgcagaaatgntaaattcaancaaagacnttaagaagtttgaaattattgaccggcnaaaatcattttatgatgaagaacaanttattgatcttgtctttgttgtaaaccaaattaacggttggaacagactaaatattattagtgatagactataattgttcatataaatgcagagtttcatctcgaacgctatatcataacaantcatgccactatacaggtcaaatcttgtatagtggcatttttaatttatccctttgaatactgttatttaacgaatatcggtccacctggtccaacagggatacctaataagaaccaaatgatgacaaatactgtccatacaatgcttagcgcgattgaatacggcattaaactagaaagtaaggctccgagtttcatgcgtttatcgtatttttgtgcataagttaataataaaggtaagtacggcatcatcggtgtaattggattggtaattgaatcgcctacacggtaaatgacttgcgtaaatgcgggatgaaagccgataaggattaacattggtacgaatatcggtcctaaaataccccatttagccgatgcgcttccgattaacatgttgaccattgcactcagtacaataatacctagtatcaatacaataccgttttgatgttctaataatttggcacctttaacagcagcgataattcctaaattactccactttaaatacgcaagtagctgtgctgcaaaaaacacaataacgataaatgttcccattgatcctacagcatcgccgaacattttacctaagtcttttgtatttttaatttctttgcttaaaatcccataaactaatccaggtactaaaaatacgacaagaataattaatccgacaccgttaattaatggcgcatcgtctagtaagctgcctgttttagcatttcttaaaaaactatgttcaggaatagctgtaataattaataaaataattgtgactatgaaactgatatttgcccattttaaagcatgtgcttctttgtcagtaatatgtgaagatgcttcttcagggtcatg

SEQ ID NO: 67 - DNA (Genomic DNA), 1442 bp; single-stranded, linear
ctatgatagnatcggaaagatgtataaagttatctaaaagttatacgacacaagtacacgaggcacatcgctatgcggtgtgtcttntggtatgcaatcaaagaggtgtaagagatgaccaagcataataacatttattagcatggncgtaagtcatatcaatacgattggttctatcattcaaaagcatggaagaagttaagagagatagcattagatagggataatcatctttgtcaaatgtgtttacgtgaagacatngtaacagatgcaaacatagtgcatcatattatttatgttgatgaagattttaataaagctttagacttagataatttgatgtcagtttgttatagctgtcataacaaaattcatgcaaatgataatgacaaaagtaatcttaagaaaattagagtattaaaaatttaaataaaaaaataatttatttttatagccccctacccatcggcttaaaatgttttttcgacgggtaccggcgggggcccttcgcttgcaacgcggataaacttttatgaaagggggtctttatatgaaattaacaaaaaaacagctgaaagaatatatagaggattataaaaaatctgatgacatattaattaatttgtatatagaaacgtatgaattttattgtcggttaagagatgaacttaaaaatagtgatttggatgatagagcatacaaacaaggctggtgccgagcaatattgttaagaatccattaagcatagaactgacaaaaacagntcaaacactaaataacttactcaagtctatgggtttanctgcagcacaaagaaaaaagatagcncaagaagaaggtggattcggtgactattaaagttttaaatgaaccttcaccaaaactattaacaacatggtatgcagagcaagtcactcaagggaaaataaaaacaagcaaatatgttaaaaaagaatgtgagagacaccttagatatctagaaaatggaggtaaatgggtatttgatgaagaattagcgcaccgccctattcgattcatagaaaagttttgtaaaccntccaaaggatctaaacgtcaacttgcattacaaccatggcaacattttattattggcagtttgtttggttgggttcataaagaaacaaaactgcgcaggtttaaagaagctttgatatttatgggggcgaaaaaatggtaaaacaactactatatctggtgttgctaactatgctgtttctcaagatggagaaaacggcgctgaaatccatctnttagcaaacgtaatgaaacaagctaggattctatttgatgaatctaaggcgatgattaaagctagcccanagcttagagaaaattttagacctttgagagatgaaattcattacgatgcactatatcttaaaatatgcacaggcttcagacagtgataagtggttggttaa

SEQ ID NO: 68 - DNA (Genomic DNA), 332 bp; single-stranded, linear
gaattcaagccgaccgatganggttatntganattacataagacgtggtttngtnantcaaagctatgtccagtttgtaatcggaggcgtgctatgaaaantagttatcacgctcananagtgattgangangtaattaaggaaaagccancagcacgttggttgttttcaccactntcaccaananntgcgatagatggagatactttagtaacaaagttngangcatctaactaangcatttgataggttgagtagcatatnaaaaggttaaacanaatctngttggatctatgcgtncaacagaagttnccgcctacctaaaaatgacg

SEQ ID NO: 69 - DNA (Genomic DNA), 1070 bp; single-stranded, linear
ccatccgttcncntcatcncangacnttcnananttaatttttacnaggagtgacatctgtgaataacacacaatcctcaccacgcagtnatantattattgcgattatgttgtctgcattaacatattgggtgtgtgnacaatcatttattaatataggacctctcgnnggncaaacgtatcaaacctctcctgccgtgttaaatttatctattagtttaacttccctcgccacaggtatcttcatggtggctgcaggtgatattgctgataaaataggacaantgagaatgacatacatgggtctcataatcagnatgtttgnatctcttctattaattatatcggacatcactgcactgctcatcatcggnaggaattttacaaggtctatcagcagntatcttggttaccctccaacagttggcgttttaaataatcaatttaaaggagaacatttaagacgagcgattagttatctaatgattagtactgttgggggcatcggcctagctggtgttatcggcggtttaattgctacaaatttcggatggcaaatgaatttcatcattagtatagtcattgntttcattgccatattacttctaaaaggcacacctgaaaaagtaagtcaacatagncaccgtcatccgttcgattacaaaggtatgtcgattttcgctgttatgattggtagctttacattattgttaacacaaggattcgaacaaggttggtttagtacattctcattcatttgtctgagcatttttatcatcactacgctgatattcatcatcatcgaacgtcgacatgaagtacccttttattgatttctcagtattacgcaaccgnccgntcattggtgcatttttaaataactttgttttaaatagcggtctaggcgttacagtggtctttttcatatatgctcaaacacaccttggtttatcagctgcgcaatctggattgntacattggcatatnccatagtggtagttgcgatgattcgtcttaggtgaaaaaagcaacattacggttcgggtgggcaaattggatgctcatcatgg

SEQ ID NO: 70 - DNA (Genomic DNA), 1246 bp; single-stranded, linear
gaacaantggtaaaaccacgacttcnaacttaattggacntactttaaaagcaaataatatncnaattatacncaataatgaaggtgctaatatggctgcaggtataacttctgcatncatcatgcaatcaacacctaagactaaaattgcggtaatcgaaattgatgaaggttcgantccacgtgtgttaanagaagttacacctncantgatggtatttactaatttcttnagagatcaaatggatcgcttcggtgaaattgatattatggttaatnacatngnagagacaattagtaatanaggcatcaanttattgctaaatgctgatgatccatgtgngagtcgggtgaaaatcgcaagtganacgattgtgtactatggtatgaaagcacatgcccatgaatttgnacaaatgtacgatgaatgaaagtagatattgnccaanctgtggtcgcttattgcaatacgattatattcattataatcaaatnggtcattatcactgtcagngtggtttcanacgagagcaagcaaaatatgaaatatcangttttgatgtggcaccgtttctatatctanatatcaatgatgaaaantntgatatgaaaattgcaggtgacttgaacgcttataacgcgttagnagcatatactgtttnaagagagctagggttaaatgaacaancaaattaanaatggctttgaatacgtatacatcagacaatggtcgctatgcagtacttttaananagaacgaaaagaagcgatgactcaantttagctaaaaatcctgcaggaatgaatgcanagtctatcaagtgggtgaacaattagaaggcgaaaaagtgtatgttatttcgctaaatgataacgctgcagatggtcgagatacttcatggatttatgatgcagattttggaaaaattatctaagcaacaaattgaagctatcatcgtgacaggtacacgagcagaagaacttcaattgcgattgaagttagcagaggttgaagtaccaattattgttgagcgtgatatttataaagcaacggcaaagactatggattataaggtttcacagttgcaataccaaactatacatcaattagcgcctatgcttgacaattaaaccgtccgtttgaaggagggcaatcataatatgcatgaattgactatttatcatttnatgtcagataaattgaatttatncagtgatataggaaatattattgctttaagacaac

SEQ ID NO: 71 - DNA (Genomic DNA), 751 bp; single-stranded, linear
cattcaagaattatctatactttaagcccgactaaaatctatagaacagcattactaaaagataatgacatttattttccagaagaattaaagagtgcagaagatcaattatttacaatgaaagcatatttgaatgcaaatcgaatcagtgtgttaagtgataaagcgtattattatgctacaaagcgtgaaggtgaacatatgagtagtgcgtatgtttcacctgaagacttttacgaagtcatgagattgattgctgtagaaatattaaatgcagatttagaagaagctcataaaggatcaaatcttagcaggaatttttaaatccgncattttagtttttctccgtacgaatggcttctcacttaaagttaaacttgaagagcaaccacaatggattaatgctctaggaggactttatacaagcagttccagaacgtgtagatgcattggtgatgagtaaattacgaccattgttgcactacgcgagagcgaaagatatagacaactatagaactgtagaagaaagttaccgtcaaggtcaatactaccgttnngntattgtagatggtaaattaaacattcaattcaatgaaggcgaaccatactttggaaggcattgatatcgctaagccaaaagtgaaaatgacagcatttaaatttggataatcataaaattgntacaggagctaacggttaaatgatttatgattggcgaagggacaattatgatgttcaaagctttaaattt

SEQ ID NO: 72 - DNA (Genomic DNA), 1394 bp; single-stranded, linear
cctgtttgccctaatggantcgggtnacaatncacggagatccttcttctcacatcaatntnaaatggggtgttcaacctcatctttgatctgatgacgatgacatgcgcggcatgcaacttgtccgntcaatttgttcaagatcattcgtacgnataaaattagtaatnttaacgtgtatcggnaatnttaaataaatgtttaatgcttttgagaatacagttctanccgnagacgtcggggacactaaatcaccggagacgccaaggtcttttattaaaccttgttcactatattgcatatactgtggatactgtcncaacacattganttgataaggatgtgttggtaataaaataaaatctttgggtatctctgatatatctatgtctgctaattgatacaacactttctcaacctgatcttctttaccttctacatagcgcgtgagcagaacatctggatgcacagctaaataatgcaattggaatgatgtatgacattcgggtgcatatttctctaaatctgcttctgaaaacccacttgcactcttaggagtcgggatgaaatggatgacctaagtattnaagantggtctgaaacgatataacgatcctctacgtaggctattgtgttacttgggaaagaacgcgccgngcgatgaatgctattatcgatgncaaacataattngcgccatatgttggttgcactgccgtttgattatctgcactttgagccatatgtggcaaaatacgcgcaattgcttctttataagttgttatttttttactttttccatcgataagccatacctctggatgatacatatgatgccccatcgcagaccaatagcgaaattcacccgttaaagtttcgagctctgataattgtatagaccattgatgattttgaggtggtacttgatataaattttcttctctaaaatattcatttaaaatgcgttcgatagccgcatacgctgcatgttgtattaattctttattttgcactttttggtttcaactcccataatttcattaatgtgtgatcggttgatttgattagtgatggttgaacaaattaaaaataaactacttactgcaaatactacgcccataacgataaacgtagtagctggtgtagtataacttgtaatggcagcgccactaagactgccaataatttgaccaacaactaacatactgttcgtcgttccaacaaatgtgccnttaagntgttgatgacacgcantcacgacaacaaacatgacactttgaatcnatgcactagatgttaatccttgaagtattcttgcagccattaaanactctatattcgtcgctaaaccttgcagtatcgcactacaaccacatgcaatcgtggcaaatatag

SEQ ID NO: 73 - DNA (Genomic DNA), 459 bp; single-stranded, linear
ataatatgtctaattgactaacttgttggagtcatttactattttatgtatgacatattttaaaaagtgagggtcaagcatgtcttataaagcatatccactctttagagatatattaataaatgaatgtatttatttcgcctctaaaaataaaaaactagtacgcctaaattataaaagtgaagcgtatgtaggcgtttggacagaagaaagtgtggccgtatcatttttaacaagtcgtgatattccatntgataaagttgtaaaaatggacgttgatccgccgngctacttatgaattagatgaattgtgtgatgaacaagacatattattatgaatcaaacaatggaagaagaagggcatctactaacgtggggcttgntacaaaaagaaggtgatgacgggattagataaaanagatcaaagatttgggcccagatgttgcaaatatgatgaag

SEQ ID NO: 74 - DNA (Genomic DNA), 930 bp; single-stranded, linear
ctggtgcgtcttctaatgaatttagagattttttaccaaatcaccatatgcagtatacgatgatgaagtatgcacgtgaacatggtgcaacaacttacgatttcggtggtacagataatgatccagataaagactctgaacattatggcttatgggcatttaaaaaagtgtggggaacatacttaagtgaaaagattggtgaatttgattatctattgaatcagccattgtaccaattaattgagcaagttaaaccgcgtttaacaaaagctaaaattaaaatatctcgtaaattaaaacgaaaatagattaacgactgaaatctgaacgctcataagactgtcatttgcgttcagatttttttacacaatatagaatggttgagtaaaatatttttgaatatagtgaaagagggggaagtactgtgataaaaaagctattacaattttctttggggaataagtttgctatctttttaatggttgttttagttggcttgggcggtgtatacgagcgaagtgctaaattgaaattagaattactaccaaantgtacaaaaatccagttatttcaagttacaacaacaatgccggggtgcaacgccacaaagtacccaagatgaaataagtagtaaaattgacaatcaagtaagatcgttggcatatgtgaaaaatgttaaaacgcaatccatacaaaatgcttcaattgtaacagttgaatatgaaaataatacagatatggataaagcagaagaacagcttaaaaaagaaatcgataaaattaaatttaaagatgaagttggtcaaccagaattaagacgtaattcgatggacgcttttccggttttagcatattcatttcaaataaagagatgacttgaaaaagtacgaaagtactgaatgacaattaataccaaatacaaacggagat

SEQ ID NO: 75 - DNA (Genomic DNA), 744 bp; single-stranded, linear
tttaccttccttaattgcttccaacccaatcatcagctaataatccactactttttcacccatgctctttcacnaatgttttgaactgcgtttcctttaacgtcataccaacctgttttacctacttttgtaatattacttgccaacaccattttattattataagcgatttggttagctatcgtgaacataggttttaaacatcgtctgtgcacccataaaggtatgcctatccaggttttttgattactatcagtagcatcagatttccaaaaaccatattgattggcgttgtctgcaacagactgcacagaagcttctttagaaactagatattccggaacatgataatttttacgaatgttatcaattaaatgactttctaaagtcacaaccggttctatttgaatcggatcacctacagctacaactttttttgaacgatataatgctcccacagctgcttgaggtattgcttgtcctgcttcatcaataaataagtagtctatgaaatcttgtggtatgcccccatacatagatttaaagcttgcaaacgtcgnactaactactggaaatatnaaatgcatcacattccatgcgtngtgtnctttatctggatgngcatcaattaatttccttctatcttnaaaatcattaatcgcataataaatagttggttttattagcaatcaataataatttatgcaatatcaatngcttcttaaaaagagcatggaccgtctt

SEQ ID NO: 76 - DNA (Genomic DNA), 858 bp; single-stranded, linear
ggcctggataagtagtaccagtccacataatctaacctaagacaattaagattaagattgatcgcatgattcaatttatttagctttgtaacccaatcatattgantaaatctttagggtgccaatatggtggtgcataanccacnncaaactcagttaactcatctacagttagctggttcatcattgccatcgatagtacatcaatacgtttatctgcaccttcttttcctactgcagctgctcttaaaatctgacggtttgaagtgtcataatatacccttaagtgtaaaggggaatttcctgggtaataattcgcgtgtgcaccttgagtgacttccaccattttatagtcaaattgctttagttcatttggtttaacgccgacactcgcaaatgtataatcaaagaacttcacaatattgttgcctaagaagcctttgaattcaatagtgtcatttccagcaatttgttcggcaacaatacttgctgcacggtgagcgccccaagctaaaggaacactagccggtagatcgacatgtcgataatgtgatgttgcaatatcgcctattgcataaatgtttggaacatttgtttcaaatttatcgtttacggtatgaaaccttttcgatcaagtttgatatttgaactttcgataaattttgaattggggtgagtaccgacaccttcaataatcatatcgtaatgttcaacttttcctgatttaaatgtaatttcatttccattgatagcatcaattcctcatttaacggtatggatctccgctatctattcaacaagtattggttgcttcatgtcagcatccatatttatttatcttatcagatcgatgattaa

SEQ ID NO: 77 - DNA (Genomic DNA), 1004 bp; single-stranded, linear
ggaatgcgatatgcctttttattcatcgtcatataaattgcattttcatttttacgtgtcatacgctgaaaaggatgcttcacaaattgtggtgtagtataaccaattccaatttccaaatacaacactttatcatcttgatgttgctctagaaaagcattataacgttgnngntgngcctgaaattcagcatcttcaaccatgccaacttccgctttacgtttattcacttccattggagcatcacattntggacatcttggaatcatctcccaaggtataagcatatcttgttgcgcaacaaccattttacgaattaaatcatcattgcgatacgtgtgagcatgacaatgctgactacactgntgnagtatatactccccntgtatatgaaatacatgagtcatatcatattcagcagcatcgaaagcattgtctgcattcggagntatgatatggtactgtttaccctccactaaggattttaatgcgagataagactgacctacaggttggatcttaataatttantgtaataaaacgactctcaaatgcccaatactcttgccaactgccataaggatgtaaactcgcttgcaacatatcaaagaagcgatatttttcaataaaatctgggaaattttccgtaaaacgctctcctacatatgtaaatccgtcagatgcagacatgcctgcaccaattccaatcactatcgcatctgcttcatcaatcgcagtacgcaatacttcagcctgctttgtcttttcatccattaaaagagacattgcattccatttactactctgcatcacggctcaatgcctccttatacagttggtaaatccttatcttggaaatacattgaacacgactttcaatgttgaatttggctctgcgagatagctttcttctgttcgacagcatttctgctgcttcatcttgagaaaagcaatacactgtagatatacagcaaagcgacatgatttaactatgtgggccaggc

SEQ ID NO: 78 - DNA (Genomic DNA), 717 bp; single-stranded, linear
atattagcagctgtgcttgcttgtattttagctggtgtaccctatcaaagcaattattgatagtttaactacattttcaggaatagagcatagattgcaatatgttggtactaatagaactaataaatattataatgattccnaagcaacaaacacgctagcaacacagtttgccttaaattcatttaatcaaccaatcatttggttattgtggtggtattggatcgagggagatgaatttgacgaactcattccttatatggaaaatgttncgcacgatggttgtattcggacaaacgaaagctnagtttgctaaactaggtaatagtcaagggaaatcggtcantgaagcgaacaatgtcgaagacgctgttgataaagtacaagatattataganccaaatgatgttgtattattgtcacctgcttgtgcgagttgggatcaatatagtacttttgaagagcgtggagagaaatttattgaaagattccgtncccatttaccatcttattaaagggtgtgagtattgatggatgatgaaacgaagancgatcaacaagaatcaaatgaagataaagatgaattagaattatttacgaggaatacatctaagaaaagncggcaaaggagaaaggtcaaaggctacacatttttctacntcaaaataaagatgatacatctcaacaagctgattttgatgaagaaatttacttgag

SEQ ID NO: 79 - DNA (Genomic DNA), 650 bp; single-stranded, linear
ctcttcttcatcaacatcgatcatacttactaaattgtggatgtgaaagctgtgatgagtatatgtacttctcgnncaaaacggtttaatgtntcctccttttctccagggtggtataaaaatcgccttaattgcaaccttaatgttaagtatcgtatcttctgcaagataaacggtactcatgccaccgncgccaagcttatctacaattttatatcgcacatttattattttacctatcatactttatcacctncaatagccgcgagtatgaaagtaacgttatctttcgaatggttatctaatgccaattgcattaattgatcaccatgatcttctattgtaccttcttttactaacaaacgcttaatttcattgtctttaacataatcagttaatccatctgaatttaataataaataatcataaaaatttaatcgcttaataaacaaatctggactcacacgtttatctgtgcccatcaccttcgtaataatattacgttgtggatgtgtaaatgcttcttccggcgtaatttgacccgttaaaacaagatgattacaaatgagtgatcactagtaatttgcacaattgtctactattaatacataggctctagaatcaccgacatttggtatcacaactgattt

SEQ ID NO: 80 - DNA (Genomic DNA), 524 bp; single-stranded, linear
caccaagaacttacttatattttagacaacataaaagggaataataattatggtaaggaatttgttgcaaccgntgaagaaacattcgacattgaataaagcggggtgaagcactatgaatcaatgggatcagntcttaacaccttataagcaagcggttgatgagttgaaagtgaaacttaaaggcatgcgcaaacaatatgaagttggtgaacaagcgtcgccaatagaatttgttactggtcgtgttaacccgcatcgctagtattatagataaggcaaacaaacgacaaataccatttggataggttaagagaagaaatgtacgatatcgctgggtttaagaatgatgtgccaattggtagaagatattgatgttggccgccaatatttttaaggacaaagaaaagattttaaagntattggagaccgagattatttcccgnacactaaaggaaggtgggtaccgtccgcttcangtcaatattggatttcccaactggaccaatacaaggccaaaattt

SEQ ID NO: 81 - DNA (Genomic DNA), 751 bp; single-stranded, linear
cgtctatcattgttaacatatatagcaccttccttattttaatgttgttttagttgaatgacagtaaaaaggttgttaagatactcatacatttttatgtgtaaatatctacaaagttacccanctactgacaatgtttatttnagatagtatatgtaaattcacagatatgctaattgcttaaaaaatgattaaagtgttggctccaagcaatgatactttagaaatttatttatcatctngactttaaaaattatattataaatgacgtaactgacaacagatatacttagtaatgaagatgtgtaatgtaattgtttaaaattgatctccaagcagattttatttatcatttaatttaaatagcaagtggaggtacaagtaatgaaatttggaaaaacaatcgcagtagtattagcatctagtgtcttgcttgnaggatgtactacggataaaaaagaaattaaggcatatttaaagcaagtggataaaattaaagacgatgaagaaccaattaanactgttggnaagaaaattgctgaattagatgagaaaaagaaaaaattaactgaagatgtcaatagtaaagatacagcaggttcgcggtnaaagcagtaaaagatttaattaaaaatgncgatgatccgtcttaaaggaatttgaaaaagaagaagacgcaattaagaangtcttgaacaaagactttaagaaagcaaaangtacgtngggataacatgatatgatgttaaac

SEQ ID NO: 82 - DNA (Genomic DNA), 785 bp; single-stranded, linear
cctttgtttancatccttagtcagtgtcataaggttgtcccatcagaaggtagnccccacaatagttgaaatcctcccacaataggggtagnctcctgcatctgtaaatacctactggnntgccanatactttttctgctggtgtgtcaaagaaatttgttgttccatttgagagaacactaataattttgacataatctgcatatcgcatataaattgttgcgttatcacgataatcttcatgtaaatctgctaaagcgttaataatagcatcatacatgtctgctcccncaacttctttaacagatccattataaaatgacatgtgttctaatccagatttaggacttactgctaaggcatctttacgctctttagctgctaatcctgattgtagtgcgttttcaacccagtttactaaatctacatctgatccatgaattacagtatctgaaattgcagcaaatactttgaanttattaagtagtgaacttgactgtatcaccttgtgcttttaattcttgtgctgtntctacgtctgtaatgaaatcatcatcgtctaaagtgtatgaaactcttggaatctctaaacctttaatgttagntagacgagcttttacacgtaattgggtttnnagcaaatggctctgaaacaatttcttgtagaaagtgggttggggaagagcttatctccacctgaatcatttcctgttggtaaagcgtgtaataaacgttgtgcctccattgaaggtttttcaaattcatttggtaaaatcgctcgtgcc

SEQ ID NO: 83 - DNA (Genomic DNA), 924 bp; single-stranded, linear
cttnataaanancnatcntatgccaatttgaccattgtttgaatccatatanaaaccggcnacggttcttttcaaatataatagtaagtgtataatgaaaatgtaaatattattaaanatgggggttcactcaatgaaaatgaaacgttttatagctattgtaatggcattatttttagtattagntggttgctctaattctaacgataataatgaaagtaaaaaagatgacgcagacaatggtaagaaacaagagattcaagttgcagcggcagcaagtttaacagatgtaaccaagaaacgagcttcagaatttaaaaaagagcataaaaatgctgatattaaatttaactatggtggatcaggggcatnaagaaaacaaattgantcaggcgcaccncttgttgacgtattnatgnctnccnaantnctaaagatgtagatgcattnnnaagacaaggaatnnagcgcatttgatatcatatnaatatgcgnnnnatagtctagtattaattggtgataaaagattcaaattacacttcagtaaaaagacttaaaagncaatgataaattagcattaggtgaagtgaaaactgtaccagcaggaaaatatgcgaaacagtatttagataacaataacttatttaaagaagtcgaaagtaaaatcgtttatgctaaagatgtaaaacaagtattaaattatgtttgaaaagggttaatgcgaaacaaggttttgtgtataaaactgacttatataancaanncnnaaaaattgatactgtaaaagtaattaaagaagtagaacttaagaaaccaatcacatacgaagctggtgctacatcagatagtaaattancaaaagagtggatggattcttaaatcagataagctaagaatattaaagatacactttgcagcataaga

SEQ ID NO: 84 - DNA (Genomic DNA), 536 bp; single-stranded, linear
ggcacgagctcgtgccgaacttacggcacgacgcgatacnataaatacatttgttacagttacgctactaatcgtttgtgctacatctttaaaatcaaccgcaatacctttgtgtttgtgaagtaacgtgtttaactctctcgttttagataataagctcatgaatttctctccttgtgtatatttttatagaataaatgcacttaaatctttatntgttgaaattgattttaatttatcatcaacatattgtggggtaatatctacaactgcattcggcatacttggtgcttcgaatgataaatcttctagcatcttntctaaaattgtatgaagtcgacggtgcaacaatgtngtcttgtatcttggattcacttggataagcaatctcaagcttaaggcgantaattgcttccatcgggtaaagtttacaggnaacttcttcttntttgggagcaatgcttcatatttggnntaattaatgacaatgtggggtctggncaaaattcttacaaaatcttcctncccgttancta

SEQ ID NO: 85 - DNA (Genomic DNA), 802 bp; single-stranded, linear
ctaccttcatgttttgtaaagttgattaaagcattcattgcttgtgtatcacttgcattttcaaaagttactctaccaatgtcgtggtaataagaatgttcaggcccaataccaggataatcaagtcctgctgaaatagaatgtgctagttgcacttgcccaccttcatcttgaattaaatacattttagtaccatgtaatacgccaggtgatcctttgncaattgcaagtgcatgtttatcagtatcctcgccttgacctgcggnttcaacaccgnattaatgcaacatcatctttaataaatggataaaaggcacgagaccgattgcatttgagccaccaccgatacatgctacaattgcatccggaagtcgaccttctttcttcaatatctgtgatttnatttctttaccaatgacactctgaaaatctctaacaatcgttgggaatgggtctggacctaatgcagaacctaataaataatgtgtatcatctacatgacttacccaatattgcaatgctttattaactgcatccgataaagtcccttgancttctacaactgccacaacccttngcaccaagtaattccattctaaatacattaagttggtgtcttttaatatcttcacttcccataaagacaacaagttccatatcaaataatggaggaaccggaggactagctacaacatgttgacccgcaccagtttcagnaacaagcttcttcttggccattctttttgcaagcaacggtgactaacgcatataatttatggcgccgtatgattagatcctctcg

SEQ ID NO: 86 - DNA (Genomic DNA), 662 bp; single-stranded, linear
ctattcttctatgtctttgacaagcgcgaatatttttcgtcgttgcttgccggtaatttgaaacggatctatgacgcttacatcgacttccacatcaaatccgttatcaagtagtaatgtttctttattgcctaattcaacacccgagatgacaactgttgntgtaccgncatcttgagtgatataactagtaattattggcatctaatcattccaatcagaacgggaggtctgaaaaatcttcttcactattgtcaaacggattattgccagtttgagcttgtccttgttgttgataattgttgttttgntgttggttgttattcttcggttctaagaattgaacgctgtccgctactacttctgtcacaaatacacgtcgcccttctttgttatcgtaactgcgtgattgtaaacgtccatcaacgccagccaatgaccctttggataaataattatttacattttctgcttgttttctaaaagttacacagttaataaagtctgcctcacgttctccttgagcgttagtaaatgttctgttaactgcgatagtgaaagtggtnacactcacaccatntgggcgctgttctatattctggatctttttgggtaagcgtcccacttaatactgttctcgtnntaacattatttgntttccc

SEQ ID NO: 87 - DNA (Genomic DNA), 656 bp; single-stranded, linear
ctggtaaaacaacattaacagcagcaatcgctactgtattagcaaaaaatggtgactcagttgcacaatcatatgacatgattgacaacgctccagaagaaaaagaacgtggtatcacaatcaatacttctcacattgagtaccanactgacaaacgtcactangctcacgtcgnctgcccagnatcccgctgactacgttaaaaacatgatcactggtgctgctcaaatggacggcggtatcttagtagtatctgctgctgacggtccaatgccacaaactcgtgaacacattcttttatcacgtaacgttggtgtaccagcattagtagtattcttaaacaaagttgacatggttgacgatgaagaattattagaattagtagaaatggaagttcgtgacttattaagcgaatatgacttcccaggtgacgatgtacctgtaatcgctggttcagcattaaaagctttagaaggcgatgctcaatacgaagaaaaaatcttagaattaatggaagctgtagatacttacattccactccagacgtgatcctgacaaaccatcaagatgccagtgagacgtatctcaacacngtcggggtctgttggtacaggcccgttgacgtgggcaatcaagtggtgaggaggtgggatcac

SEQ ID NO: 88 - DNA (Genomic DNA), 390 bp; single-stranded, linear
gaatgcccacanaatgatgctggcaatgattttcacttagttatgagcggtaatgaattttgcggtaatgcgacgatgtcatatatacatcatttgcaggaaagtcatttgcttaaagaccaacagtttaaggtgaaggtatctggctgttcggatttagtgcaatgcgcaattcatgattgccaatactatgaagttcaaatgccacaagcccatcgtgttgtgccaacaacaattaatatgggtaatcattcatggaaagcattagaaattatttatgaaacatattgtacattatgtgattccnagctaaacaaagtnacaacttgaaattcaacatttggntggaagcatttgtgccgttgancaacaaatggagtcacaaatatt

SEQ ID NO: 89 - DNA (Genomic DNA), 423 bp; single-stranded, linear
ggnacgagcgcatnattaaaaacatatcaggttatgtatgcgcataaaaaacagccttgaaaaacctttataaatcggattttcaaagcgtgttttgaaaggtatttaattaaaactaagcatgttgatgtaaatcatcaaagtttgttaaacgttgttgccactcattatcactaatattatttgcttgaacataacgattacgctcatgtttagcacattcataagagcatgcacctaaatatttagtttcgntttcttcagaaactaatatttgtttattacattctgggttagcgcaattaatattaacgntcacatgggtttggcatcaaaacccaatccttaccaataattgttttttcaacttgggttgatatcaacactgatacggatcaacaanttacaatacaatttnacccg

SEQ ID NO: 90 - DNA (Genomic DNA), 891 bp; single-stranded, linear
ttggtgcaccacctcaaaactttggtaccattgatgcattgtacattaattgcgccaagtttttgttaatgccaccaatgattcaggtaataattgtcccaaaagcagcagttacaattaaatctacatctaattgaancaattgttctaattcttctgatccacttaatttttcaggctgatatacaggtaaatcatatttcattncaacttttttaactggtggtggtgtcataacacgtttacgtccaacaggtcgatctggttgcgttacgactgcaatgacatcatgttctgcaataagcatttctaaaacagttgttgaaaaggcacgagtacccataaatattattttagtcatttataaaatatgcctccacttctttatctgttaaaatacggtccgcacgttcngtaaaagggagaccgttcatttgatctataatatgcaaaatcattcttgctacatcttcatgtgcagttagttcaactttgttcccattgacgtcataactttcgacaactatcattttacttcttgtcacttcgccgtaaacatctggcaatgtaattgaaccttctaagtctgttattgtttcatttgattgactaataattttcggattaacaagttggtaataatccttccatttccatattcaataattggcacttggcaatgacttgattaatttgagggtgcacataagccagcagcttcttggtgcatacattggtatcttcttaaatcttggtaataatcttttttacgaatcacaattgttttaacttgcttgcgctttttccggttaaataggatgcgatgctgggtactaacttttttaatcgccaatactcttactcctcaataaatcaatcaactatataccg

SEQ ID NO: 91 - DNA (Genomic DNA), 652 bp; single-stranded, linear
ggcacgagctataaatccaatgatgaattgtaaaagtgaataattgagaaaaaggttaatatcaaattttggtgtcatcattaatgtaagttccttggctaacgttgagaaagttgttaagccacctaaaaaaccggtgacaaagaacgcagggaaccatgagattgaaattgataggcctatagttaatccaattaaaaaactaccaactagatttactatcaatgttgcgataggtaactttgaagtaaatttatgattaaaataatcagtaatggcacttctagcaattgcgccaaaaccgccgccaatcatgactaaaatgattgatatcatgataaaccaccacctagttttataccgacgtaacataacaaaatcccaaagacataacttgttacagcatatagtagtaaagttataaattgttgatgatcaaacatatgtattaattcttaattgaaatgttgaaaaagtcggctaaagcacaagaaaacagtcgtaatagctttttttagggtcggatggtttgaaaaaatgcaatcgttaagctgttagcatcccattacaaaggcaccagtcaatggtatcagtgtccgatggaactccgcagtatcagaaagatgaggtacgtataaggctaagcacaccg

SEQ ID NO: 92 - DNA (Genomic DNA), 1142 bp; single-stranded, linear
gaaaccatccccncgtgctcgtcactgattgttccgccaccaccttgtgttccaccacttgatttgatcagcaggattgaaagtacctctnccacagtaatacccattattagtcccaccaaaacctgtacattacctgctgatgctcctttcacccatgggctcgtattatnacgacgtgtaaatgtcgtnaccacatttccattacgtttaataactaatttgtcagcatatgtcgtaacattaccagcatgagtattgactgtttggttcgcaccaggtgcaattgtaatcgctcctgccgctgtttcagtgacagttggtttcgctggttgaacatcttttactacaaatttcgctggtaaagatgttgcaaatgtatgtccattatagatgacatcatattttgcattaacgacttgtgcagtatttggtttattcattgctgcccagtttgcatcgtttgtacccgtagtatcacgattccatttatacgtaaatccatctgttggtaaacctgaagcgttttgcatatgtgcatatcctgatgcttgcgtaccacttgctaaagtgccaccaactgttgttgtataagtagtttgagggaattccaaattgatatacgttcacagttacaggaactcgtttagcagctgaaatacctggatatgtgacatcgacatttaaatgttgaacgcctgcttgctggttatttggttgttgtctatttgcccatgctgctgtaataccattcgtattagtatttggatcaaatgtaatgtaatcaatagcgtttgtaccatgtgtcaaattttgacctttcacatcacgtgatggcgccttagcattagcaactggataaactttgactggaacttcaacattacgcgtaccttgaccactaggtaatgttacaaccgcagttttatgtgtgttggcgactgtattcttccatgtatctggactatcatgccatgcgaccgctggcccatgtggnggattttggaataaatcgtcttcatgaccgaaatcaaaaccgncgcacctttaataaatacagcgcttcagtagttgcttgtattgtggggttactgtacaagaagcactatcatttgatcacagatcaatcttggtnntngaac

SEQ ID NO: 93 - DNA (Genomic DNA), 605 bp; single-stranded, linear
ggnantngaggaancaaancngcccttcnacncggattaaaacctgttngaanctgnngaagngtgggncnaannccttgantgcaaggtgcganggncgnntgcaagntgtnnaacngcnngngancgnttgncngtgcantgnncaagantggtgaaaacccntgtgntanattgtgcgnccnncttggtgangntgngttgngcngnntcttcagnagtcgcanctgcagngtgtccnataagcgctntntgnacggttgctggtgttgcnnantcatctatcgcaacatcgntaattgttgtatctccagtaataccttgaatatcagcaactgcttgatcattaatttgcgtaacatcattagttgnttgtgcanttaagatatcttganacgctttttctttagcttntaaaactaaatcttttgctgcatttttctcttcagttgtagcgccagttgtattatcaattgcttgattttgagttgtcacagcttgatcaacttcatttttcgcattcgatttaactgctgntgctggttgtgtgctttgaattanagaagactcaagcttgcatgcctgcagtcgactctagaggatcg

SEQ ID NO: 94 - DNA (Genomic DNA), 1778 bp; single-stranded, linear
aaattcataataaagncttttgncattaaagttnnaaagaagataaagaanctgctnnaaattgacgtatcnnaaagaagtaaaagaagtttaaatantcaaataataaatcnacaacacaaganatttctgaagaacaaaaaggtgaatatcaaagaaagtcagaggcattaaaagaaagatttataaacagacaaaaatctaaaaatgagtctgtggtttcactaatcgatgacgaagacgacaacgnaaacgacaggcaacttgtggtttctgcgccatcaaagaaaccaacaacaccgactacatatactgaaacaacgactcaggtancaatgcctacagttgagcgtcaaactcagcaacaaatcgtttacaaaacacccaaaaccattagctggattaaatggtgaaagtcatgatttcacaacaacgcatcaatcaccaacaacttcaaatcatacgcataataatgttgttgaatttgaagaaacgtctgctttacctggtagaaaatcaggatcactggttggtataagtcaaattgattcttctcatctaactgaacgtgagaagcgtgtaatcaagcgtgnacacgttaagagaagctccaaaagttagttgataatttataaagatacacatagttagaaaagaccgattaaatgcacaacaaaaagtaaataccttaagtgaaggtcatcaaaaaccgtttaataacccaatcaataaagtanccatgccaataatattaatgcatggctgcaaagcaaataatgagtttgtcgtaaaaataccaacatttaaactagcaataaataatatccaagtcatcatttcattgatgcaatctagtatagtccacattctaaacaggtgtggactattacttttttcactttatattaccgaaaaaattattatgcttaactatcaatatcaataattaattttaagctgaaaaacaataaaaatgttaagacaacgtttacttcaagttaattattatactgaaaattctggtatataatgctgttagtgaatataacagggaaattatattggttataatattgagtctatataaaggagaaataacagatgaaaaagaaattattagttttaactatgagcacgctatttgctacacaacttatcaattcaaatcacgctaaagcatcagtgacagagagtgttgacacaaaatttgtagttccagaatcaggaattaataaaattattccagcttacgatgaatttaagaattcgccaaaagtaaatgttagtaatttaactgacaataaaaactttgtagtttctgaagacaaattgaataagattgtagattcatcggcagctagtaaaattgtagataaaaactttgccgtaccagaatcaaagttaggaaacattgtaccagagtacaaagaaatcaataatcgcgtgaatgtagcaacaaacaatccagcttcacaacaagttgataagcattttgttgctaaaggcccagaagtaaatagatttattacgcaaaacaaagtaaaccaccacttcattactacgcaaacccactacaagaaagttattacttcatncaaaatcaacacatgtncattaacatgtnnatcatgcaaaaggattcttttaatanacactttattgttacacatcagactcgcctagatatacacatccatctcaatctttattatcaagcatcatgtgcagctcctggatatcacgcgcataatttggtacacagggcatgctagcattaa

SEQ ID NO: 95 - DNA (Genomic DNA), 1568 bp; single-stranded, linear
gtgcttttgttcaagcttctgatcaattttttatcgtcttttgtaatttcgcgaatgtcttcaaacattgataagacaatctgacccacattttgtaattctttttgagtttcttgtaatgcaacaccaggtgcgtgataaacaagatctttgtgtaagtgctgaggnntatagtcancagcnatatctttacctgggacaagctttgtanctatccatgctaaacctgctacanatggtaattgaatcanagtatttgttatgttgaagataccatgtgatactgcaatcgtcatcgctgggtttaagtgccatacatcttgtaacanactaatcaaatgaatcacaactggcaagaaaattgtgnagataattaccccgantaaattaaagatgacgtgtacaagcgccgcacgttttgcagcgattganccggctaaactagctaagatagctggaattgtgggacgagacaatgttatcacctaggaacacagggattgctgcgtttnagctgattaaatcttgttgataaaattcttgtaaaataccaatcgncggacttgaantgttganctagtgctgttacccctgcgccgacaatgacaccaagtattggatgtgatgacaatatcaagcattaattgnttaaaatccatctaatgatgctaaggggtttancggcatccaccccataaattctaagaccgaagaaaagagaccccgaacccgatagtatgcggccaatgttattgattttaagagcgtttaaaagaaaaagattaaaaatgcacctaatgctaaaattggcatttgcatattcgcctaaatctaatnccgataataaatgcagttaccgttgttccgatattggcacccattatcactccaatagcttgttttaacgtcataaatccagctgttaccagtccgattgtgataacggtcgtacctgaactactttgtattaaaatagttacaacgatacctgcaataacacctaatactggatttgatgtaaatttgtttaaaatatctcgtagcctgtctcctgctgatgcttgaagcccgtctcccatgatttttaagccgtaaaggaaaatacctaaaccacctaaaaaggagaaaatgacttctgtaaccgacatttccattattttcacctcaaataagctttatatttagattatcgcttataattgtaaatttaatgttaagattaggtaaaattatttaacaatatatgttatttgtanatgacttgtaaaatatcgtcacttattatgtnaattttcagtgtgaaatggcaggtntgcaataacgtgtttaacaaaatgatgcaatcaatcatgtaattatgtttcatcaaaaaaatcatgtgagtgggataacgaaataaagtttgtgaacatatcatttctatcccactccatgatttgaaatcaccaaataaaaatctattaatggttttcgttataacaatttgtgttcttttaataatgtctcaatgtacgtaccttttatctttttaaggaatcctgctaatgcgagtttctgcattttcgaat

SEQ ID NO: 96 - DNA (Genomic DNA), 1317 bp; single-stranded, linear
accccattgattcctgaatcccctgaaagaagttgaatcaccttgaagatcctgattccncctgtactttgtgaacccactgaaacttattgaagaagaatcccctgancctgtctgatgttgataatgatgccgacaccgatgtgctttgtgatgccgatgtactagcactcattgacattgatgttgatatcgatgtacttaaggaaccagatgcacttgtacttgttgactgccttgtgacattgaatcacntaatgatgtagatgtgcttgttgagctcgagtcacttacacttgttgaacctgatattgagtcacttaaacttgtcgatgttgaaactgatacgcttccgctcattgagtcagatgttgaaagtgatgtactcgttgaatttgatccactgatgttagacgaatcacttgtagacattgagtcgctttctgatgcactgatgctcatagagtcaaattgactattacttgttgagcttgactgcgaatcgctcacacttgttgacgttgattctgatccactcaaactttgcgagctactcaatgattttgaatcacttaatgaatccgaagtgctaagacttgtggaaccacttaaagatattgatccacttaatgagtcggagtcacttgtactagtagaatcactcattgatattgaatcacttagcgaggtagactcgcttacgctttctgaaccacttaatgatgttgaggtactcaatgaaccagatgtacttgttgaagtcgaaccacttgttgattttgaatcacttaatgaatcagattcactcacgctttctgaacttcttagtgacgtcgatacacttaatgatgacgaatcgcttgtgcttactgaatcgctcatcgattgtgagccactcaatgaacttgactcgcttacactttctgattttcttaatgacgttgagacgctcaatgagccagaatcactgacacttgttgagccactcatcgatttagagtcactttcagaattagattcacttacactttctgaatcatttacagattctgacatactttgtgaatcagatatgcttgcgctcattacttcactagccgatgttgatgtacttgtcgaatcacttaacgatatagatacactcatcgaaccagatgtactcgcacttgttgagtctgatgttgaatcactcacactatcagataatgacgttgaatcactcatacttgttgatgtacttgttgaaagcgacatactttgtgaatcactagtacttgtacgcatcgaagtactagttgacagctgatgtctcgtgcc

SEQ ID NO: 97 - DNA (Genomic DNA), 2146 bp; single-stranded, linear
cccaaattggcgatagctaatatttgataatgatgcgcatttcatacaatttgtgacttggcaattattgaatatttatataattttttctcgtaataaacacaactttgatagcgctaaaacagctgtgttaagttatgagttaacgaatttaacacattttactagggcggcatttaagaatatttatacgtttttancgaatatttatttattgtaanacgctaccaaaaagttagacttccttcccactaaagtnccacttttttctttcaacttttttaanaaacggatatgcaacttttagtattggtatcaaaatgattgttaggtcatattctatcaatatatttttctaaagaattgcttttattaactttcaattatgtacctaacctaaaaagaagccaaggcaacgaatgttaccttgacttctaatacatattcaactaactatatattcaatcatacgcgcatgcgagagtgattgttgtacatctataatgcgttgatttaaagaacctttatatggtaaatcaggtttgaataagtgttgtataaatagaccatcgactaaaacgtcaatgtatgataataactctcgacgttctgtacaatcatttgctaaatattcatataaaaatccagtccatacccaaattgtctttgtatttccaaaacgtgctcgaaatgctttgacaagatttaatgtaatatccaaattacaaaatggttcgccacctaatagacttagcccagatatataatcatgatcgcaatcatctaatatttctgctaatatttcatcagtgtatttctcgccatatctgaacttttgtgaggctttgttataacatccaacacaattaaatggacatcctgatacataaacactgcatcttactccttcaccgtcaacaaagctatttgaatcctattttagcaatataaccttgtccttgtttaatgtcctaaaagtgtcatcctttaggcgccttcatatgttttactcgtgcgcaaatttctttatgacggcctttaattactggacgttgaactggattgcctaagtaacccacatgttcgtttaacgacatcaactgttttaggattatcattgncacaagttcgggcatttaaatcctttttcagntgcttcaaaatctccatccgnnatcacattcaataacaatggancaaatcggnatatttggnncctaaggttaaccaacttnggcaataagagtngggcccaatacccgnttctagggctttcaaattgtgttgcaatttcggatactcacaatagtgaatgaaaccaccactcgcataataaggataatctttttcaaaatctaacttttcaaaaggtgtaacatctttacgtacatcataatggaaagagttttgataatatcctttatctgtaatgtctttaatatctccaaatctctcttggtctaaacgacaaaaacgatccgttagcganncactcggcgtactcgtaaatactganccaaatgtcatataattctgnccatngcgtgtgataacgtntcatttctttaagaatnacaagcgtaaatgcttgngcttctngagatgtctcccagtctggaccatagaaaacagnagctgtntcatacaaccctatctagcccattgaaatcgttgcacgtttatttttaaataactcagcaacatcatctgtttcttttaatttatagttaaaagcgccacttttatataaaattggtgcgttattcggtacagnatctttcaaacgatttatacgataaagtaatgcatcatgtaacacatcgatacgttcataaaagatttcccagaatttcgtcatattaccggcagattctaatgccattctaggtaaattaagtgtnacaacaccaagattacaacgaccattattttcaaaatgaccttccgcatctttccaacttgggtaaaaatgaacgacaacccattggngctttgaaatcacctaatatttctacgagtttggtcaataatttaaaatatctggatacatacgtttcggnggaacaactttaatgctagttgtttaatgtcataggtcggatcttgggggactaaagttggggtcccntctctattggaaatcaaa

SEQ ID NO: 98 - DNA (Genomic DNA), 1015 bp; single-stranded, linear
attgtcccacaccatttactacaaganacgagcgtcctccacattgttacnttgtgcnatcaatncttctngtttgttttgaannnaagaccgaagcatttgtantctgctgtgttcgcagccttgtttcgcacgttctaaggtattgaataccgtttaatgcagtattggcttgtgtaacagcttgcattgctctatcgacatctgcnttaggtgtatttcctccagctgttttatntaaaatagttgctgctgcatttactgcttgagaataagccgttcgtttagcatcatcagcatcttgataattttgactttgtaacgtcgtgtctttatcacgaattgatgtttctaattgacccatagcaccatctaattgttgcgctttggctttaactgtattaacacctcaacatttgttgctngtgtaatttcattatctaacgcattacgttgtgcattattaatgtgtgttaatgtacctaacgtttgtttcgcagcagctttagcttcatttaatttcgcatcaccgcncaacgccgtcttcgtactgtncacattgtgtaatgcttgnncaactgctgctttgtctacattgtgaccactagcttttgttaaaattgcttttgctgcatttactgcttgatcataagctgatttcttacttggctcagcatctaggtatttctgagtttgttttggttgtgtctcatcattgataccattttgtaaacttgtgcattgcgttatttaattcttgttgctttngcaggttcttggatttacaccagctactgtaggtggnaccatcaatgttaagcgttaacgcatctttttgtgcattgttaattgatgttaagttattcaagtttgtttttcgctgttgtcttagcttgagctaagttttggcgcaccatttaatgcatgttctttagtnggtcacttgtgatgttgcttggcgtaatagtattngggntccatccnntggnttccacgtttggattaatgattgctt

SEQ ID NO: 99 - DNA (Genomic DNA), 1550 bp; single-stranded, linear
ggcaccagctagagcgagtttttatatatacaacacgaaagaagacattgatcagttaataaatgccttgaaacaaacgaaggagtttttctcttatgaattttaataatctagatcaattatatagatctgtcattatggatcattataaaaatcctacaaataaaggtgtattanataacgggtctatgacagtagatatgaataacccgacatgcggtgaccgtatacgactaacatttgatatagaagacggcattataaaagatgctaagtttgaaggtgaaggttgttcgatttcaatggcaagtgcatcgatgatgacacaagctgttaaagggaatccanttggagaagcaatccaaatngacccaaggaatttaccgnaaatgatgcttggttggaagcctantgtgatncagggaagaatggggagatattgaagcattccngggttgatctcaatcccagctcgtattaaatttgtccacataccttggaaacattggaaaaagggtccttgttcctaaaggagggtaaaacaggagggtccggcttgaagaagaaaagatcctgttaatcataagatgattttgatattaagacatatnnaagtatnnnaatttttaataaagatgtcatgtcattgtaataaatatggtttacatcattgaattaaaaacttacgcaccgccgttgtaaatatatttttaaggagtgattgaaatggctaaaaaagcacctgatgttggggattataaatatggattccccgccgatgatgtatccattttcagatcagaacgtggtttaactgagaatatcgttagagaaatttctaacatgaaaaatgagccggaatggatgttagatttccgtcttaaatcattaaaattgttttataaaatgccaatgcctcaatggggtggcgacttatcagaattgaatttcgatgacattacttactatgtaaagccttcagaacaagctgaacgttcatgggatgaagtgccagaagaaattaaaagaactttcgataaattaggaattcctgaagctgaacaaaaatatttagctggtgtttctgctcaatatgaatctgaagttgtttaccataatatggaaaaagaacttgaagaaaaaggtattatctttaaagatacagatagtgctttacaagaaaatgaagaattattcaaaaaatactttgcttctgtagtacctgcagcagataacaaatttgcggcgttaaactcagcagtatggtcaggtggntcgctcatttatgtacctaaaaatatcaaactagatacgccactacaagcttatttccgtattaactctgagaacatgggtcaatttgaacgtacattaatcattgctgatgaaggtgcttctgtacattacgtagaaggttggtactgcaccagtttatacaactagntctttacactctgctgttggtggnaatcattgggcataaagatgcgcacngtccgcnttattcttacgaancaaaactgcgggacaatgttttcaactnnaggtac

SEQ ID NO: 100 - DNA (Genomic DNA), 1449 bp; single-stranded, linear
tgataatactgcttaatacaacatttattgcaattaaaagtgcagtaatagccagtttttcnttganttcaaaatgantgtcctccntttttgtttgtaantaatcactatgcttggctttattatggtcanntaaacgtgtttccatttgttgatactaacattttcaataattgattcgcttcatattgtgaagtttgaaactgttcanctatgggcaatgtatttatttctgcttctatactttgantggtatgttccgactgttctagcgcattttgtttcccgtaattttgaaagtttactgcttgtttttgatgcttttttaacatatccattttagtctttatcgtttggttctgatgaatctgtgcttcaatttgttgatatgttttgatagaancccaaattttaattttanttgcaatataacccgcttgttccaaancgtcatctttataaaacaatttatttgaatcaccnatttcgggctcctacttcctttaccaaacttgccatttaatggaatactgtttagcttcatctattcgtacttccactagtttacccaatcatttctttaggtgctttgaaattaactagcttatttttatcagtgtagccagcaagaacctgatcatcttttttactactaccttcacaaagtactgttacagtttgtccttcgtacttactcatagctatttgtgaataatgaccaacttttttattcaaacgttgcaatcgttcctttttgacatttaaaggtacattatctttcattttagcagcaggcgtaccatcacgttgtgaatacaagtacgtatatgcatgttcaaaaccaacttcatcatacagagttaaagtttcttcaaattgttcctctgattcatttggataccctacaataatatctgtagttaatgctacattaggaagtctatctttgattcgttttactaaatccaaataactttctcgtgtatattttctacccattatttttaatactgcattatttccagattgaactggcaagtggatatgaggaacgatattaccaccctctgaaataacatcaatcatgtgatctgtaaagtcccaaggatgacttgttgtgaaacgaactcttggaatcgctattttagaaattgcttgtaaaagatctcctaagtcatattctatatcctgtaaatctttaccataagaatttacattgtgacctaaaagcgttatttctttgtaaccttcacgagcaagttcacgtacttcatctataatgtcttcaggtctacgggtccggtccttactccttgtnaatggaacaatacaatatgtacaaaacttatcacaaccatacataatattgacccatgctttatgttgcttcacggacttgtggnagattacaataacgtctncttcttttagacatactcacaacaatgt

SEQ ID NO: 101 - DNA (Genomic DNA), 459 bp; single-stranded, linear
gaaagtgtttcagaacgtggagcaaaaggcttcggaagtagcggagtgtaaagacatcttagatcgagttaaggaggttttggggaagtgacgcaatacttagtcacaacattcaaagattcaacaggacgaccacatgaacatattactgtggctagagataatcagacgtttacagttattgaggcagagagtaaagaagaagctgagcgcaaatacgaggcacaagttaagataaggagagatggagatgccaaagaaaacggnaacgattgatgtagatgaaaacttattagtagtagctagtaatgaaatatcagaactattatatgaatatgacagtgagttaatcncagctggatgaagatggcgataatagagatatcggaaggaaaaaagaggacgcattaaaacaagctatacaaaatttctcgataaattacatgggggtgtttagtg

SEQ ID NO: 102 - DNA (Genomic DNA), 2005 bp; single-stranded, linear
ggcacgagctcatacatcgctagtaagaataataatcttagtatttgtttagtcattccccacactcccttatattttcaaacaactgactcactttagcataattccatctctcctatcttaaccttgtgcctcgtanttgcgctcagcttcttctttactctctgcctcaacaactgtaaacgtctgattatctctagcagtagtaaaatgttcatgtggttgtccttgttgaatctttgaatgttgtgactaagtattgtgtcattcctcatagctcccttgaacttgtttgagcttactcataaaaaacattactaaaaatgctattaagatatgcgtcttttgatgtttataagcaaatgtagatatcataaagatagtagcaagcattaacatttcatatatgtttgtgtgtatagtctttttactcttaagaaaaataattgctatgcgataaaagagataaacgccaaaccctattaaaaatatttctaacatgtcgctcacttccccaaaacctccttgactcgatctaagatgtctttatactccgctacttccgaagccttttgctccacgttctgaaacacactcgaattcctccacttgctttagttcaggtgtccatataggcacgataaccaattgagctagtttgtcgccttcgttgatttgataagttccatattgtcttatggcgtcactcaaatcgatttctcctttaatatcaaaaacacctggtgtgatataaccattcgatgcaatagcgtcattcttgatattaatccctaaattgccgtgatatcccgcgtctatcttgcctgtttcaatcactaaatgcgttttactacttacaccactacgactagttaatagtccgacatagccctctggtatactcacagctacatctgttttgatcactgctttttcttgtggttcgagtacgacagtttcagctgagaatatgtcataacctgcatccgtcttatgatttcgttcgggcattctagcattttttgataatagttttacttgtaatgtgttagtcattttcctattcctcctcatatttatagacaacttgacctgccataatccctactgcttcatcaagttcaatacctcntttaactgaatgttgaatagcatttgtcattccctcaagtatttcatcaaacgcttgcgctttcttatacacgtcctcaatctcttttagcaacccctctgtgtcattaccgtatacgcactagcactaataacggactgttcgattttttcgcgattattcattggtgtcatcctccataaaaattttattgtttaattccattccgaatttaactctttcatcatcgttaccgaattcgtttattaaatctttttcaacgctcttgcaatacctatcccatgcgcttgctttcttctccagttctttgttacaatctcgtaacttcgctatatccccaataagctcatctcgttgcttcttgtactcttcacgatcttttaatgctttgtgaagtttatctaataacttgttagagttagtacaaagatttttatattgttcatctgataaggtgaacgtcatctcataacctccaatagcatctcattttcaaaaatatttccaacaatttcaataatatcggcattttcacttagtaattcagttacattgctaaaagttatataaaaggctccttctttaaactcgataaaacttacttctctcgaattaacaatcttggaacaatatccccttcataaatctccacaaccgggcacatcttttaaatcctgtgtattggtaataggttttacttcaattgaaacttttattaacctggtggaaatcaaaatgtacccacttattaaaaatcggatttcggncaataatactcaataacttnnnntatcttnatcccaagcttttaatttcaacatcaatcttaccaactccccatctttccaaatcaatgtcaaccggcaangtcac

SEQ ID NO: 103 - DNA (Genomic DNA), 796 bp; single-stranded, linear
ggcacgagctgttttttatttgcttcgttacaaagcattattgaatttattttacgtgttcatattttgaaacatcaaagccgtcttgcttagctttgttgataatgtctttgattgaatgtagtcctttatcggcgaagtatgatcttaagttgtcttttgtagcttggtcagcattcttatctaataacacatcgatatagcttaattcatgttctaagaagtttgcgtcatcatgtagtacgagtccattttgagaataaactttcgcatctgcttgattaccatatccaacaacgccagttgctaatacacctaccattgccgtagctactaaaacctttttaaatttcatatctatcactcctctaaaaattgtactctatcataacacttgaatattaagaaaattacggnttattaagtcggacttnantaattcttaataaatagntaaactgacaaatattngctnaaatgcaattantcttnaaaaccggggtttatggatttttcctactaaaaccttgatttcaaaaagggtttanctcaaatgaaacaataataaaaaataatgcaacataataataagtacaaatttanttaagaaattaaattgattgtatatgtatattntggtaacgtnaaagagaaatatncaanataattaattatttatttgaaaagagaatattaatgaagtattaaacaaagagacgtgaaacgatgcgatatttaaaaagactttcatggnacataagcatcttaattttaataggtggtattgctgggtggg

SEQ ID NO: 104 - DNA (Genomic DNA), 1122 bp; single-stranded, linear
aactttgagtnttttgttcnatatggaactttaaagatttggaaattatntagatggagatatatcatataatccagaggtgccnagttattcagctaaatatcaattanctaatgatgatnacaatgtaaagcaattacgtaaaagatatgacatnccagcagaataaagcacccaaagttatttgttgaaagggtacagggtaatttnaaagcctcatcagttggatataaagacagtgaatttactttcgtagagannaaaggtgaaaatatatactttagtgatagtctacatcttganccaagtgaggataaataaacgtgaccaataaagagtatgaaatcgaacccggaaaaagagagtgtgaaatgatgaaacgattaaataaattagtgttaggcattagttttctgtttttagtcattagtatcactgctggttgtggcataggtaaagaagcggaagttaagaaaagctttgaaaaaacattgagtatgtaccctattaaaaatctagaggatttatacgataaggaaggctatcgtgatgatcagtttgataaaaatgataaaggtacatggattataaattctgaaatggttattcaacctaataatgaagatatggtagctaaaggcatggttctatatatcgaatagaaataccaaaacaacaaatggttactactatgtcgatgtgactaaggacgaggatgaaggaaaaccgcacgacaatgaaaaaagatatccggttaaaatggtccgataataaaatcattccaacaaaagaaattanagataanaacataaaaaaagaantcgaaaactttaagttctttgttcaatatggaaactttaaagatttgtcgaagtacaaagatggagatatttcatacaatccagaggtgccaagttattcaccaaaatatcaagtaactaatgatgactataatgtaanacaattncgnaaaagatatagatataccgaccgaataaagcaccanagctattgttganaggtacagggaatttaaaaggttcatcaattggctacacaaaaattgaatttactttcgtagagaaaaagggagaaaatatatactttagtgatgggctacag

SEQ ID NO: 105 - DNA (Genomic DNA), 652 bp; single-stranded, linear
cggtggtcttctattcccgttttgccatctcnaatttcttaccatggcccacaaagtattgtnacgtttgagctgatccttatttaattttnaaattgagaaaaatgtctccaaatcctgtacctnccccatattcccgcaatacaaataaaattttgtcgtatttgctcnccggtaagctttaaatgtggtcattataagancggattgtcttgtaattgaccgcatgtcataccagttaggaatcacatggatattgtcagcatttttaagaaatttgatgatttagtaagtagtttttcatttccgtacccaaggacaatgacattttcagcattcttgtagacatgtctattaatgtaacgcatcagcttatcaatcatgctacctggacgagttgcacctgtcttaatcgcattatcaggtgctatatcatacaccacaaaagaatattttttcttaagcagtctgtgtaaaacgtctggtattaatggcaagattggtggattagagtaaacaagaatctgatcatatttcaacattttaggtatattaatcacgaattttgaaaataaactaaagaaattgatgatccttccaaccttacttttgttattaaacctcgaatacttgagacgtcgaatgcgaantc

SEQ ID NO: 106 - DNA (Genomic DNA), 392 bp; single-stranded, linear
gaattcccttcaaaagcacctttgataccgaataaattatggtttggtgacttagataaagaactagcgggaagattttaatcgcaagactggtgcgaatgtgaagtatattgaagcaccttatgaaccgcataagtttgtgaaaatggtgaaggataaagaattagctgatgaaaaagaaggcggcttacgtngtaccgcttgttttgaaatgcgtttggatattgtagcgaaagcagctgtagaacatggctatgattattttggcagtgcaatcacgttatcacctaaaaagaacgcacaattaatcaatgaacttggtatggattgtccaaaaaatatacgatgtgaacttatttgcaagtgattttaagaaaactaaggtattgagc

SEQ ID NO: 107 - DNA (Genomic DNA), 3797 bp; single-stranded, linear
tcaaatgcagtcagggaagcaataggacgatatgcataaaggagatggtaaagtggaacagtgacagaaggtaaagacacgcttcaatcatcggagncatcaatcaancacaaaatagtaaaacaatcaggaacgcaaaatgataatcaagtaaagcaagattctggaacgacaaggttctaaacagtcacaccaaaataatgcgactaataatactgaacgtcaaaatgatcaggttcaaaatacccatcatgctgaacgtaatggatcacaatcgacaacgtcacaatcgaatgatgttgataaatcacaaccatccattccggcacaaaaggtattacccaatcatgataaagcagcaccaacttcaactacacccccgtctaatgataaaactgcacctaaatcaacaaaagcacaagatgcaaccacggacaaacatccaaatcaacaagatacacatcaacccgcgtgcctcaaatcatagatgcaaagcaagatgatactgttcgccaaagtgaacagaaaccacaagttggcgatttaagtaaacatatcgatggtcaaaattccccagagaaaccgacagataaaaatactgataataaacaactaatcaaagatgcgcttcaagcgcctaaaacacgttcgactacaaatgcagcagcagatgctaaaaaggttcgaccacttaaagcgaatcaagtacaaccacttaacaaatatccagttgtttttgtacatggatttttaggattagtaggcgataatgcacctgctttatatccaaattattggggtggaaataaatttaaagttatcgagggaattgagaaagcaaggctataatgtacatcaagcaagtgtaagtgcatttggtagtaactatgatcgcgctgtagaactttattattacattaaaggtggtcacgagcgtagattatggcgcagcacatgcagctaaatacggacatgagcgctatggtaagacttataaaggaatcatgcctaattgggaacctggtaaaaaggtacatcttgtagggcatagtatgggtggtcaaacaattcgtttaatggaagagtttttaagaaatggtaacaaagaagaaattgcctatcataaagcgcatggtggagaaatatcaccattattcactggtggtcataacaatatggttgcatcaatcacaacattagcaacaccacataatggttcacaagcagctgataagtttggaaatacagaagctgttagaaaaatcatgttcgctttaaatcgatttatgggtaacaagtattccgaatatcgatttaggattaacgcaatggggctttaaacaattaccaaatgagagttacattgactatattaaaacgcgttagtaaaagcaaaatttggacatcagacgataatgctgcctatgatttaacgttagatggctctgcaaaattgaacaacatgacaagtatgaatcctaatattacgtatacgacttatacaggtgtgtcttcacatactggtccattagggcacgaaaatcctgccgaattaggcacgagacatttttcttaatggatacaacgagtagaattattggtcatgatgcaagagaagaatggcgtaaaaatgatggtgtcgtaccagtgatttcgtcgttacatccatccaatcaaccatttattaatgttacgaatgatgaacctgccacacgcagaggtatctggcaagttaaaccaatcatacaaggatgggatcatgtcgattttatcggtgtggacttcctggatttcaacaccgtaaggtgcagaacttgccaacttctatacaggtataataaatgacttgttgcgtgtggaagcgnctgaaagtaaaggaacacaattgaaagcaagttaaattcatcttctgaatttaataggctatgtaaatcgtgctgttatcatggcacatcagatataagtagcatcacagtgttgaatctcaaaatagtaaagtgaaataaagcgcctgtctcattagcgaaaactaaagggacaggcgtatctgtttatgagcttaataaattgtatgaataatatggttgatcgaataactgtttatcattgatgataaatttgagttttttaaaaataattgatatattacaccattgttatagcgtttaaagaaatcaacccaactttacgataaatagtgattgcttcgtcattaggtctacgatcaaaatcatgctcgtttttattcacgcgttcaaatgttgaatgtggaacatgattcatgatatgttcgctttcctcaacgggaacatcataatcgccattacaatgcgcaatgaaaacaggtggaagtgttttaagntcatctggtgcaatattatattttgaatcagtataatcancaatgttaatcatatttatccatttacctgtgccacgtgcataaacgtagagtaaaaaacgtgtgcgatttgatcttgancaaccggtgttggtgaagtgagttgtccaatcattgtttcgtttatgctttgagctatttttgcgtaatacctattagttgttttaaaagggttcagtgttgatgcgactataaccataaaaatcaataacaccatcaatatctctgtctcgtgcaattaataagacttaaatatgcacctgatgatctgccaaaggtaaaaatagggcaattagaatattgtgattgaatcgcatcgaatgatgcgtagacatcctcaataatgcaatcgagacttacttctggtaataaacgataacttagttgaattaaatcgtaatgttccgtaaggatatcgatatactgtggggataaatcgttagctttaccgaacattaatccaccaccgtggatgtagacaataacgccttttgttggttgattttttgctttaataattgtgtaaggtaatgcaaatgcatctttagtaattactttatatttaatttcagtcacgatttaataggctccttaggaatccgatattgatgtcattataacactgtcntnaatttccatgnaaaatagtcttaagacgatgagtcatgataattctgttccaattgacgtaaagcgtcncgggtatgcttctttagaccttccccataatccatcattttaacaatatctttaaaagcagcatgtggnatggctaaatcttctaaatctgccatagaaaattcaagattgatatcatgtggtcgctgttcagcaagtttatgcacaaagtcaggttctgtgaccaaaggcgaagacatgccgaccatatctgcatgttgtaaagcatctaaagcagactctggagaattaatcccgccacttgcaattaaagggatacgacctgctaaatgttcatagacaatttggttaactggtcgaccgaaatgatcacctggtgtacgagacgtattttgataaatatgtcgaccccagctagcgattgctaagtattggatgtttgaaacgtccatgacccaatcgattaattggttgaactcgtcaatggtatatcctaaatcactgcctctggtttcttctggcgttgctcgaaatcctaaaataaaattgtcaggtgcttctttatcaatcacttcttgtaccgcacgcataacttctaaacataatcttgcacgattttttaatgagtcggcaccgtaatggtctgtacgtctatttgaaaaagttgagaaaaatgtttgaatcagcaaacgttgtgcaatcgaaatttccacaccatcaaaacctgctttaatcgcgcgtgcatcgagctcgtgcc

SEQ ID NO: 108 - DNA (Genomic DNA), 3165 bp; single-stranded, linear
caagccagttcaactnaccgacccggtatatttggggaatatacgaancncnntcagatgatcnaaatatgantganacncggtngcgttctcnagncanaacagngttaaataancgtaagtcggcagttatgtcanatgagattacttctnctgattgggnagttacgnntccacacgagannatatcanntggtganncagncagagtaaaacatagagattttgacccgccattgtatgtagaggcagaagttattgccgaagaatataacataatttcagaaaatagcacatatacattcggtcaacctaaagagttcaaagaatcagaattacgagaagagtttaacaagcgattgaacataatacatcaaaagttaaacgataatattagcaatatcaacactatagtaaaagatgttgtagatagtgaattagaatactttgaacgcaaaatacacaaaagtgatacaccgccagaaaatccagtcaatgatatgctttggtatgatacaagtaaccctgatgttgctgtcttgcgtagatattggaatggtcgatggattgaagaaacaccaaatgatgttgnaaaattaggtggtataacaagagaggaaagcgctattcagtgaattaaacaatatatttattaatttatctatacaacacgctagtcttttgtcaagaagctacagaattactggaatagcgagtacttagtagataatgatttgaaagcggacttacaagcaagtttagacgctgtgattgatgtttataatcaaattaaaaataatttagaatctatgacacccgaaactgcaacgattggtcggttggtagatacaaaaactttatttcttgagtatagaaagaaattacaagatgtttatacagatgtagaagatgtcaaaatcgccatttcagatagatttaaattattacagtcacaatacactgatgaaaaatataaagaagcgttggaaataatagcaacaaaatttggtttaacggtgaatgaagatttgcagttagtcggagaacctaatgttgttaaatcagctattgaagcagctagagaatccacaaaagaacaattacgtgactatgtnaaaacatcggactatnaaacagacaangacgggattgttgaacgtntagatactgctgaagctgagagaacgactttnnaaggggaaatcaaagataaagntacggttanacgaatatcgaaacggattggaagaacaaaaacaatatactgatgaccagttaagtgatttgtccaataatcctgagattaaagcaagtattgaacaagcaaatcaagaagcgcaagaagctttaaaatcatacattgatgctcaagatgatcttaaagagaaggaatcccaagcgtatgctgatggtaaaatttcggagagaagagcaacgcgctatacaagatgctcaagctaaacttgnagaggcaaaacaaaacgcaggancttaaaggcttaganacgctgaaaaganagctaatgtttatacagacaacaaggtcaaagaaagcacagatgcacagaggaaaacattgactcgctatggttctcaaattatacacaatggtaaggaaatcanattaagaactactaaagaagagtttaatgcttctaaaagaacactatcaagagtgttagcagacatcactgtaaatgctatgaaaggcatctatttaaggtatgacgaaaatggggcgattacttcacatactattgataaagatggcgtgaaaattagtggcgataaagttgatataacagcgaatagagaatttaatgtattcgcaaataatattaataacaaagttggtaaaaatgacattgttaatagcctaaacttatcaaatgaaggtcttgacatcaatgtgaatagaattggtattaaaggcggaaatgctaaccgttatgtacaagttcaaaatgattttattgaacttggcggaatcgtacaacgaacttggaaaggcaaacgatcaaccgatgatatattcacacgtcttaaagatggacatctaaggtttagaaataataccgcaggcgggtcactttatatgtcacattttggtatttcaacatatattgatggagaaggcgaagacggaggttcatccggtactattcaatggtgggataaaacttacagtgatagcggtatgaatggcataacaatcaattcttatggcggtgtagtcgctttaacatctgactacaatcgaattattatcgattcatatgcttcagctaatattgaaagtagagaagcgccgatatatttatctccgaacacccaaaaattaaacctggntttaanccgattcgcattcacattatcaaacgctgataggtncattacgaaactggcggttatatcatgttgggttcaagatgnaanctataagtncggtgctggattaagattttctaaacgtaccaataaaggattggttcaagtcgttaatggtgactatgctacaggcggagacactacaattgaatcaggtatggccaaattcaacttagttaancggaagagatggaaatagttacgttagcattcaaagttatgatttattggcggtaggttctgataatgctggcgatagagtcgcttctaattctatttataagcgtacttattcagcacctgctaacttacacattacttctgctggaacaattgggcgtgctacttctgccaaaaagtataaaatttcaatcgaaaaccaatacatcaatgaagacgatcagttcagtcattcaaaagagattttaaagcttccaattcgtacatggtttgacaaatatgaatcggaaataatggctaaagaattggaaagtggtaaaaagttatctgatgatacttttaaacttagtcgacatactggcttaatagcggaagaggttgaagaattaggatttaatgaatttgttatttatgatgacaacggagaaatcgaaggtatcgcatacgatagactttgggttcatctannacctattattacccnaaaaccancantcaaanancgnaaaacntantggnggnnttaacntctnatngacngcaaccagggtccncatnccacctccacattatacaantcactttctcncgtcacta

SEQ ID NO: 109 - DNA (Genomic DNA), 1229 bp; single-stranded, linear
aaaacaagcgattatcacagcaattattttaatagcactgagcttgattttacctgcatttgcagtaggtaatcacatttcaatcttcgtcatttctatgatattctttgcaggtagctttgctttaatgtatgcacctttacttaacgaagccattaaaacaatagatcttaatatgacaggtgtggctattggtttttataatttaattattaatgtggcggtatctgtaggtattgcgattgctgcggctctaatcgattttaaagcattaaatttcccaggcaatgatgcattaagttcacatttcggtattattttaattattttaggtttaatgagtattggtccggattagttttattccgncatctttaaatccggtgggacaacaatcttgaaaaataaatagatattaaatcgcgagatatatccgtattttattggtaaaattaaattaaagagattatattacacgaggagtagtaagtattgaaattggagaaatatatagatcacactttattgaagcctgagtcaacacgtacgcaaatcgatcaaatcatcgatgaagcgaaagcataccattttaaatctgtatgtgtgaatccaacgcatgttaaatatgcagcagagcgactagctgattcagaggtgctcgtttgtacggtaataggattcccattaggtgcgtcgacaactgcaacgaaagcatttgaaacagaagatgcaattcaaaatggtgcagatgaaattgacatggtcatcaacatcggcgcattaaaagatggacgttttgatgatgtacaacaagacattgaagcagtggttaaagctgcgaaaggtcacacagtaaaagtgattattgagacggtattgttggaaccatgacgaaattgtaaaagcgagtgaattaacaaaagcggctggtgcggacttcgttaaaacttcaacaggttttgcaggtggcggtgcgactgcagaagacgttaaattaatgaaagatacaagtaggtgctgatgtagaagtaaaagcatcaggtggcgtacgtaatttagaaggatttcaataaaatggttgaagcaggtgcgacacgtattgggcgcgagcgcaggcgttccaaattatgcaaggtttagaagcagattcaagattactaatatatataaaatttgggagtgatagctatgacaaagaccatttaatcgngttcattttatccgtatgg

SEQ ID NO: 110 - DNA (Genomic DNA), 1066 bp; single-stranded, linear
ggcacgagacgtaaatgnaaagaaaaccggcctncntgattaaganatttagaaaagtgtttgtcatnacggttgtcccagtgntnagtatgtccaaatanaggaagtganaacgatggnaccgtatttttaaaanaggcagnacatancattttagataggaagtgataatatgaatttggctaaacgcanattacaaggggaacnattaacaanagagactgtagtgaaaatttatgaggatactaatattgataccttagntttattaaatgaggcgnacatctttaagnanacattattttggtgcnatnagtcaaattaaacatgattttaaatgctaaaagtggnatatgtcctgagaattgtgggcncgagactgtggacaatcacgagatattaaacaanaacagcgatatgctttaattccagaggaacaaattatcgatngancanaggtggcacatgataatcatattggaacatattgtattgttatgagtggtagaggaccgagcgataaagaagttgatcatattagtaatcctgtaagaacgattaaatctcaacacccgcaactaaaaatctgtgcatgtttaggattaacggattgccgaccaagctaagaaacttaagtcagctgttgtagacagatatanccacaatattaataccaagtgaaaattacccattgataaccgtcgtgccaacgcatagttatnaagatagaacagatacgatagaactaatgaaagcgaataatatatcaccatgttctggcgtgatttgtggtatgggagaatctaatcaagatattgttgatatggcatttgctttaaaagaaatggatgccgacagtattccgattaattttttgcatccaatcaaaggcacaaagtttggaagcatggatgatttaacaccaatgaaatgtttaagaatcgtagcattattccgattaatcaatcctacgaaagaaattcgtattgctggaggaagagaggtcaacttacgttcgttacagccattagcattaaaagcggcgaantncaatatttgggcgggg

SEQ ID NO: 111 - DNA (Genomic DNA), 3222 bp; single-stranded, linear
ccaagtaagtatagaagcagcatccttagaaaagaaaaatgtagatttgaacgaattattacagcgtctcaatgacgttgaacaaacggaatacaccaggttcgcttnaccctaaatttttaaatgtttcgtcacttattcaatatattcaagcagcatatcatgaacctcttagagaagaatttaaaaatttaacaccttatgtgacgaaattatcgaaagtacatggacctaaccatccatatttagtcgagttaaaagaaacatatgatacatttaaaagtggcatgttagagcatatccaaaaagaagatgatgttgattttcaaaactaattaaatatgaacaaggtgaagtagtaaacgatattaatacagtgattgatgatttagtatctgatcacattgcaacgggacaattgttagtgaaaatgagcgatttaacatctagctatgaaccaccgatagaggcatgtggtacgtggcgactcgtttatcagagattaaaagcacttgaagtgttaacacatgagcatgttcatttagagaatcatgttttatttaaaaaagtatcataaataacgcgattagaaactgttggcaaagtaatgtcagcagtttttcgctatacttaacagaaatttagtgatatgaacagcattatttgaaaagaaaaatggtcaacttagcataaaaattgatatgaaaatttaatggtatagataattaaatagtagcgtgtttttttaataatttattcatgaattttacatgcactattatgataaaataaacataattataattcactgaggtgctatcgtgctatcgctaacaatgttattacttgagcgtgtaggtttaattattattntgggcctatgtgttgatgaattattccatatttttaaaaactttaatgaatccgtcgacgctacatggaaagcacgttggcaattatgtattattttcagtttgtttgccttaatgttctaatttaactggtatcgtcatcgatcatcaacatagtttgtcaggaagtgtgtacttccgtttagatgatgatgtatctttagctaacacacgtgtattaacgataggtgtcgcaggattagttggtggcccttttgtaggtctatttgttggcgttatttcaggtattttcagagtgtatatgggtggggcggatgcacaagtttatcttatctcatctatatttatcggnattaattgctggttatttngggcttacaaagctcaaaggacgcaaagcggttacccgaggtatttggcgaaaaagtggccaatgaattggganttggttattgggaaatgaatcaaatgtnggagcaattttaacatttttccccacgacaaagcatattgcggttgactcatatcattaattgcactaccaatgattattgttaatagcgttggtacggcgatttttatgtctattatcatttccaacattaaaagcaagaagagcaaatgaagcctgttccaaacacatgacgtactgcaattgatgaaccagacattgccgtattttaaagaaggattgaatagagaatcggcacagcaaattgcgatgattattaaaaatttaatgaaagtatctgccgtagcaattacaagcaaaaatgaaatcttatcgcatgtaggtgcaggtagtgatcatcacataccaacaaatgaaatattaacaagtctgtctaaagatgtattgaaatcaggaaagttgaaagaagtgcatactaaagaagagattggttgtagtcatccgaattgcccgcttagagcagctatcgtgacaccacttgagatgcatggttctatcgtcggtacattgaagatgtattttacaaaccctaatgatttaacttttgtggaacgtcaacttgcagaaggattggcaaatatttttagtagccaaattgaacttggtgaagccgaaacgcaaagtaagttattgaaagatgctgagattaagtcattacaggcacaagtgagtccacattttttcttcaattcaattaacacgatttcagctttagttagaataaatagcgaaaaggcacgagagttactattagaattgagttattttttcagagcgaatttacaaggctcaaagcaacatacggattactttagataaagagttaagtcaagtgcgtgcatacttatcactcgaacaagcacngttatccaggaagatttaatatcaatattaatgttgaagacaaatatcgcgatgtgcttgtaccaccatttttaattcaaattttagttgaaaatgccatcaaacatgcgtttacgaatcgaaagcaaggtaacgatattgacgtgtcagtgattaaagaaactgcaacacatgtacgtattattgtacaagataatggtcagggtatttctaaagataaaatgcatttgttgggagaaacatctgtagaatcagaatctggaactggtagtgctttagaaaatttaaacttacgcctaaanggattatttggaaaatccgcagcattaccaatgtgaatccgacatcgagnggtaccactttttggtgtgtaccttccttatgaaagacaagaggaggaataaatatgaaagcattaatcatagatgatgagccattagcacgctaatgaattaacatatttattaaatgaaattggtggttttgaagaaattaatgaggcagaaaatgtaaaagaaacattggaagcacctacttgatcaatcaatatgacattatatttttagatgtcaatttaatggatgaaaatgggatcgaattaggagctaagattcaaaagatgaaagagccacctgcgattatttttgcaactgcacatgaccaatacgcagtacaggcatttgaattaaatgcgacagactatattttgaaaccgtttggtcaaaaacgtattgaacaagcagtcaataaagtgcgtgcgactaaagccaaagatgataataacgcaagtgcaattgcgaatgatatgtcggcgaattttgatcaaagcttacctgttgaaattgacgataaaattcacatgttaaagcaacanaatattattgggattggcacacataatggtattacaaccatacatacaacgaatcataaatacgaaacaacagagccattgaatcgttatgaaaaacgattgaatcccacttattttatacgtattcatcgttcatatag

SEQ ID NO: 112 - DNA (Genomic DNA), 805 bp; single-stranded, linear
atcaatgtaacctaatagtttatgtctatcttgtgtaccaactactacatcgacaccaggaatttccataatttcagctgatgaagtttgcgcataacaacctgttacacagattacagcatcaggattgtgtcttattgcacgtctaattatttgacgactttttttatcacctgtattcgttactgtacaagtattaataacaaatacatcagcattcgcttcaaagtcaacgcgctcatagtttgcttctttaaataattgccagattgcttcagtttcataatggtttactttacaacctaatgtgtgaaacgcaactgttgacataaatattcaccccattaattctttttcataacttattgcacttaacgcatacaatggcgcagtttctgcccgtaaaattctcggtccaagaccaacaactgtactagtattactaaataatgaaatttcaatttctgacaaaccaccctcaggaccaaaaatcatcaacactttatcctgagccttgaattgttgtaaagtntgcttgaaattgcttaactcaccatcttttgcttcctcttcatatgcaataagaatatagtcntaattatcaatagtatcacaaattaattttaaattccgactccgaattgaatagatggaatccactaaacgaatagctttgttcagcagcttctttaattattttttgccaacgctctatctttttgacaactttcgcctccgtttaatttaacaattgagcgttccatgctcacagctataaatgatgaagcacccaattcatagcttt

SEQ ID NO: 113 - DNA (Genomic DNA), 1448 bp; single-stranded, linear
ggcacgagcgtagatttagcattttcaagagaccaagaacacaaagaaatatgtacagcatcgtataatggaagaaagtgaacgtttcaatgaatggattgagcaaggcgcagcaatctatatttgtggcgatgaaaaatgtatggcgaaagatgtccatcaagccattaaagatgtattggtaaaagaacgtcatatttctcaagaagaagcagagttattattgcgacaaatgaaacaacaacaacgctatcaacgtgatgtttattagcgattggtgttaaatattttaaggtgtaatgatgtaaaaagatataaaggatgttgctcaacatgaatatgccattaatgatagatttaacaaataaaaatgtcgtcatagttggntggaggcgtcgttgcaagtcgtccgggcaccaaacattaaatcaatacgttgaacatatggacggtcatcagtccgacaatcactgaaaaacttcaaaatatggtagataacggtgtcgtcaatatggaaagaaaaagaatttgaaccaagcgatattgtagacgcgtatctagttattgcagcaaccaatgagccacgtgtcaatgaagcggtaaaacaagccttacctgagcatgccctttttaataatgttggagatgcatcaaatgccaatgttgtatttccaagtgcactacaccgcgacaagctaactatcagtgtatcaactgatggtgcgagtcctaagttgacaaaatcaattatggcagagcttgaggcgttatatccaccatcatacagttcgtatatcgactttttatatacttgccgacagaaaataaaagtacttgatataacatatatacgaaaagcaacagttactgtcacaaattgtgtcacaagaatatttaaatcatgacaaacaagctcaatttttagcgtggttggatgtaagataataatagcggaccgtctaaccgtctaaggtaagtcttcttattttaactttaacgcttaatcattgaaattaagacatgggtggctttgtgaatagtctaataatgaaggatttaagcgataatgatatgcgttttaaatatgaatattacaatagagaaaaagatacgtagaacaaacttaataaaatagatggataaattgaaatctggttgaagtcgttactatcatagcgacctttagccagattttttgtgcaatagaaagcaataataaaaatgatagatcaanatgaaatacaggacaggatatacaaggattagtcatgccatgttatcaagtaggaaaatcaaacttcactattgatagttacgcanaaagatttttttgataaaatgagataacttaaagataaaaaattatattaattataatatttaagttaaagagggggattatgtaaattgtattaaaagtggagggagaaaataatatgaatagtgag

SEQ ID NO: 114 - DNA (Genomic DNA), 1127 bp; single-stranded, linear
cgacatggaagaacntanaccctcgtnnaggaggcccagaaaggnagcntnaagnnaaattaagnnaagcgaaaagcaccaacaataaaacctgatggcagcatcattcaatgcgtgccaccaggtttttatgttttgtcaagaaaattaaataaatcattaaatgattcggcccatcgtaggatgtgaataaatactatctcgtaatacggtatatggaatgttttgatcaatcgcaagtttaattatattaattaattcttcagattgcttaccatataatgtagcacctaaaatcatattattttcattattaatgactactttaaataaacctcttggatcattgttaattttgtgacgaggtatagcacttactaaaagttgatgttcagtgtaatcataatgttgagcggcagcttctttactagttaatccaacacgtgataatggtggatctataaatactgtataaggcacgctacctctattgtcagtcgtacgtgactgattaccatataacgctgatttgataattcgataatcatctaaagatatatacgtaaattgaagtccgcctttaacatcacctgcagcataaatatgtggcacagatgtttgaagttgagcattgactttaatttcgcctctatcacctaattcgatatcagtattttctaaagctaaggctgtattcggtttgcgcccgatagccaaaagtactgcatcagcctcanagttgccaacattagnacggactgttgtatgatgatcgtcagatgacaattcagtcgtttcaacatttgtatgcaatgcaatgcctttattttctaagtcagtaatagcatgtgcancgacatcttgatcttcgccgtggcataaatgattcaccacgttctaatacngttaccttactacctaaattcgcaaacattgaagcaaattctaaggcaatataaccgccacctacaataacgagatgcttaggttgatagctaatgtttaataaacctgttgaatcgaagacatgtttagcttgatcaaggccttttatgttaggaatgatagaggtagcaccggtattaataatgatatgaggtgcagtaatactagcgacgatatcgccg

SEQ ID NO: 115 - DNA (Genomic DNA), 876 bp; single-stranded, linear
gaaganatancgtggtnttgaagatttgggangttaatagatnaaggggaatatgcanttattaccgggagnnnagtatccaagnaaatctagagtcaataggttaataatcttatgcctttttaattttgaataaaagtggggtggtgtaatgtttggatttacccanccgacccgaacaagattgncgtttnacgcgattagaagnaaatgataagcctatgtttgnnaaattcgacagaatagaagacagtctgagaacgcaagaaaaaatttatgacaagttagatagaaatttcgaagaactaaggcacgagcgacaaggtagaagatgaaaagaataaagaaaagaatgccaaaaatattagagacataaaaatgtggattctaggattaatagggacgatcttctaagtacgatttgtcatagccttactaagaactatttttggtatttaaaggaggtgattaccatgcttaaagggattttaggatatagcttctgggcgtgcttctggtttggtaaatgtaaataacagttaagagtcagtgcttcggcactggctttttattttgattgaaatgaggtgcatacatgggattacctaatccgaaaaatagaaagcccacagctagtgaagtggttgaatgggcgttatatatcgctaaaaacaaaatagctattgatgtacctggttctggaatgggagcacaatgctgggaatttacctaattatttactccgataaatattggggatttagaacatggggaaatgctgatgctatggctcagaaatccaattaatagaggtagagatttcaagataattagaatcaaaagacttggtacacaaccaggcgactgggtttttgg

SEQ ID NO: 116 - DNA (Genomic DNA), 1789 bp; single-stranded, linear
ggcacgagcggcacgagcgtgttgtatcaagattttgtaggcagttttacaacgtccgattcagcaagttatgcacaagattttaaatctgaggaaaacgctaaaaagattgctgaaactttaaatcttttatatcaattaacaggcaatcaaaacggtgtgaaagttgtgaaagaagttgtggatagaactgacttgtcatctgataaatcagttgatagcgaaacaatgtaactatactaagttatgagcattacgctcatagctttcttagaaagtaggtgtagttttggatgatattcagaaaataaaaaaagagctttctgaattagttgaacgtgttgatgatgttgaaatactagcaaacgaaacagctgatcatgtgcttgaacttagagaggaacataagcaacatcataatgaactaagagaatctcataaagaacttaaagataagcaagataaagttgtagatgagaatttagagcaaacaaagatattaaacagaattgaagaaagatatcanacgcaagtagntgttgngcaaaaaaatgaagaaaagacactcgcccaaaataaatggctcgtaggtgccatatgggcgcttgtaacaattgttatgattgcagtcattactgcatcaattnctgcgttattaccttaagggaggtggacataatgagttgggcaagatggttatcatgttatttgtntggtcgtaaatgtaaataatgtttttggtcagtgcatcggcactggctttttattttgattgaaaagaggtacgtacatggtattacacagctcacaagacaggaagcatactccaagtgaagttgggaagtgttgttaataccaagtaagtaggatatctganatgtataatagagtaaaaatgaaatctttttattatagacacatataaaaagtgtatagtaatatatgtatgtataattaaatgataatcatttcataattattgtatataactaaataactacttaacanaaataattatgctttagagntgaccannatgannnannccagcatttacattacttttattcattgccctnacgttgacnacaagtcccanttgtaaatggtagcgagaaaagcgnagnaataaatgcgaaagatttgcgaaaaaagtctgaattccagggnacagctttagncaatcttanncanatctattattacnatgnnanagctanaactgaaaataaagagagtccncgaccacatttttacagcatactatattgtttanaggcttttttacagatcattcgtggtatancgatttattagtagattntgattcnnaggatattgttnataaaaataaagggnaaanagtagacttgtatggtgcttattatggttatcaatgtgcgggtggtacaccacacaaaacagcttgtatgtatggtggtgtaacgttacatgataataatcgattgaccgaagagaaaaaagtgccgatcaatttatggctagacggtaaacanaatacagtacctttggaaacggttaaaacgaataagaaaaatgtaactgttcaggagttggatcttcaagcaagacgttatttacaggaaaaatataatttatataactctgatgtttttgatgggaaggttcagaggggattaatcgtgtttcatacttctacagaaccttcggttaattacgattaatttggtgctcaaggacagtattcanatacactattaagaatntatagagataataaaacgattaactctgaaaacntgcgtag

SEQ ID NO: 117 - DNA (Genomic DNA), 1410 bp; single-stranded, linear
cgatctacattcgctgcgccaatacacacaataggataatcttcatttaaaacatatgcctttcccataacatattccttttgtattaatcctgaaataatgtttgctacgctgggtctagataatccaattgcctcagcaagttcacgttgtgaaataancggattatctttaattctttttaaaatttctttctcagnatcgctcataaccatccctcctcatattgacttaaaatacttgaatcagtgaattcaccaaaaatatcgtagcatgctgttatttctgttgtaaacgcttacattttnccgttatatcaatgatatttgtttataaaatacgcataatttcgtaaaaagtaagttcattgccatcgtgtaaaagntactcgagcaaatgataaatgtttatacagtatgatatttgtcgacaataaattatgacatttttatgtcttatatttttctataaaaaaacgtgactcattatcgattttttcatcgactgaatcacgttacgatgttttatttgtttttnctattcaatatgatgatgctatgcgtccaactgcacctcgattaatcatgtcttgcttagtaacaattggatattttttaaatacggattgaacccaagataaccctgcaagcgcaccctacaatcgccattactacaccataaattacaatagtcattggatgattaaatccanacattactaaaaatcctncaatcggtgtagctgtacctgtcgcatcgttaattaaacctgacatagcaataattaaaccagcaatcgcaccaccaaagaaatttgtaatatagattggaattggattggctgatacaatatctgcttgtgataaaggttcaatacttactgcaatcgtagacttacgatcacctaattttaagcgatggaatagcgtcccattcataaatgccgaactaaatgctgccatggcaccaatagccataggtacacccgttaaacctaataatgctgtcaatgccattgaactcaatggcgctgtgccgacaaccgtgataataccacctaaaatgatacccatgataattggattcgtattcgtactactttggataatatcaccaattcgaatcaatgtactattcactactggcgttaataatactgcaataagacgagctaatggcgctaagatgacaatcggatccaattaagtcgacaaccatccgggcacatatttctcttgtatatttcatcacatatccaatcaatatttaacccgnaaaggaaacctgggtaataaatccataccaccgcaacgctcgggccggttattaacttaatggatattctgggggatacaaccgattaggttaatgcttgttgaatcccaggcgggaggggacaacaacctagga

SEQ ID NO: 118 - DNA (Genomic DNA), 926 bp; single-stranded, linear
aattattccggtttcgccgtctttgtttgtggctatgttacattcaacaatagatttgccagtgatactgtcatcttcgtcacggttataataatcatcacggtaaagtagcattgctaaacttgcatcggcttctattccgcctgattctttcatgtctgatagcattggtcgtttatcctgcctagattcaacaccacgattcagttgtgaaagtagtacgatgattgcgcctgtctcgttagcgattatctttaagtcacgtgatatcttttctactgctacacgtctatcaactttcgcatcagtatccatcagttgaagataatctataaaaataacttggttgctcggtctgaatgcctcattggtttgagctcgcacatcttgcggtggtaatatttacttttggtcaagaaatatcaaatacctaacttcaatgatttggatcccattgcatttgttaacttcgttaagtcatccggtgttaagttcctgatttcttttatcttggttaactcaataccagtaattgttgataacatacgtttcaatactgatgtgccagttgtttcaagactaaagaaagatgttttatatccatttcgtgctatgttcaacatcatgtttaatgcaaaacctgttttacccactgagggacgcgcgtgccatgacgattaattgcgacggctctaatccccctattttgtaatccatgagcttataacccgtcttaatttgcttcttagggctatcgctgtataactcatcaacaaactcctcaacaaacttcttggttccatcttcttttttgttagtaatcgtttttaaatccttgagttcatcaatcaagttgttaaagttttggttcgtaggttgttgtttaaactcagttaccaattcgttagctttgttgagctcgtgcc

SEQ ID NO: 119 - DNA (Genomic DNA), 1406 bp; single-stranded, linear
ccaataatccattncaaggctttttcgttgccccaatnaagaagcacgagacccatcccggctattaaatacctgcaatttgaaatttgccaagggcaccatggtgtgaccgacaagtattaaaatcctgcaccagcgaaaagcattacctaatgaattattatcattaatcgatattattgtgccaaacgaaacagaagccgaattgttatctgggattaaagtaactaatgaacaatctatgaaagacaatgccaattactttttatctttaggcattaagactgttttgattacgctaggtaagcaaggtacatattttgctactaaaaatcaaagccaacacatcgaagcttataaagtaaatgcgattgatacaactgctgcaggcgacacatttattggtgcatttgtcagtcgcttaaacaagtcgcaagataacttagcagatgctattgattttggtaataaagcgagctcactcactgtacaaaaaacacggcgcgcaagcatctattcctctactagaagaagtaaatcaagtttaaatgaatcaaacacagctatgatatgaaggtttagcatataacatgcaacattcgtatatcatggctgtgcttttttatctttataaaacatcatctattagaaataattttccactaaacctatgcttgttgactcatgtttagttataaatgaagtgacaattttttgtaatctttttaacttccaaattattgcatataaatatgctatattaatgataataattatcaattaaaaggaggttatgctatgtctaaagaagctggtcatacatttttagctaaattaggaaaaactcgtctacgccccggtgggtaaagaagcaacagattggnttaatacancaaggggcattttcacaagataaacaagtgttagaagtggcattgtaatattgtgcacaacatctatttatctagctcatacatatggctgtcacattcaaggcgttggatataaataagaaagcattagaaaaagcacaggaaaatttccagcagcaggtcttgaatcatatattcaagttcaacaagcgaattgctgttaaattgccctttgatgacaatcaattcnatgtcgttttaaatgaagcaatgttaacaatgttacccatcgccataaaggaaaaagcattacgcgagtnctaccgagtcataaagccngggggtntnttgttaaccacatgatnttgtcatcgttaatgaatcanatnccacanatgttgttaaatcattatctgcagcaattaatgtcnatgtctcaccgcagacgaaacttggctggttagatttatatcatcaaagctggttttaatcaggtgcattatccatactggtccatgagtttaatgacaccaa

SEQ ID NO: 120 - DNA (Genomic DNA), 654 bp; single-stranded, linear
ggacgtaatnatacgccttttctgattatttctttactattctaaaaactgttgttctactaatacctaccattttgaaatttcatttggcgtgtacattctacttgcgaataattgtttaatatatttacgtttatcttcagaaagttgaggtcgtcctccatacctaccacgttcttttgcagattctagaccatttgttgttctttcttttaataatatattttctgaatctgctaacattttaaatacttcaataaatgattgtccttcttcactattagtatttatgcctaaatcaagcacttctaaatggatatcatatggtaatattctactttcaaaaaattccatgagtttttttggtgtgaatcctagtacttttaatttttctatcactaatgtatcatctgttttcaactcgtctaaacaatgctcaagttctagttgttctttataataaacatttacttgctcagaataaactaagtcacaaccatttattaagagtttcgttaattgagtatctagattttgatcaggatatgctacacgtgcgtaaccaattttcctcattttatacacccttccagcttattcattttctccgattaataaaccttcgctcgtgccgtttcaacaagtcgggccctg

SEQ ID NO: 121 - DNA, 1213 bp; single-stranded, linear
gcaaaggctttgaagatatgagtggtaaagaatgtacctaaggatgacattgaatagagggagtaaagaaagcgacagctgatgcatcctcgctagtttggacggcatgaatagaatgacgttaggaaatgaagttctgactaacaaaaagattgaaactgaaatcaagatgcttgagaaaaaaattgaccaaatggataaatcagaaaataattcacaagaagcagaagttgctaaagcacttattaagttagcgggtgttaataatgattaatgaaatgttaaacccgaaacaacaagaagtctggacctgctttataaacgataaacccaaagtattaatagcgagtggtgccaaaagggcaggtaaaacatatgtgttcatcctgctttttttaatgcatatagctacttataaagacaaggggcttaacttcattattggaggagcaacacaagcatctataagacgtaacatactagatgatatggagttaatactaggtagagagttaacactcgacaaatctaacgcagtcaaaatattcggtaataaagtgtatgtattcgacggacaaaactcggatgcatggaaaaaagcgcgtggttttacttcagcaggtgcttttttaaatgagggaacagcattacacaatatgtttattaaagaagtgttctcacgttgtagttacaaaggcgcgagaatattaattgataccaaccccgaaaacccgatgcatccagttaaaaaagattacattgataagagtggtcaacggttatcgaatggaagactaaatatcaaagcattccaatttactttgtttgacaatacatttttagatgaagaatatattgaatcgattatcgcaagtacaccaacaggaatgttcacagatcgtgatatttatggtaagtgggtttctgctgaaggtgttgtatataaagatttcaaagaaaaagttcattacatcacagaagaagaatttaaaactaaacaaataaaaaggaaatatgcaggcgtcgactggggatatgagcattatggttctattatggttgtagcggaagacttcgacggaaacaagtacgttattgaagaacacgcacacagacataaagaaatagatgactgggtagctattgcaaaagagttataaaagcatggcgatatcctttttatgtgatacgctagacctgacatattgacatt

SEQ ID NO: 122 - DNA (Genomic DNA), 1141 bp; single-stranded, linear
cattattatttgtcgttaaatacaatagaaaatactatacctgtatatgcaattcgacaatagataaattattaaatatgcttacaacaatcttaatatcctttaacgcactacaatagtgctctgataataggttataaatgtacgtaaaaccattgtctcaataaaaatgaaaacgtatacttcaagaaggatgggttacttaatataaacaagggggtaacatatatgactttatatttagatggtganacactaacaattgaggatattaactcattttcacaacaacactcaaagattganattattgatgatgcgttagaacgtntcaaaaaaagtagagcgggaggtgaacgtattattgaaaatgangaaacgggnttgacgggtatcactacagggttgnggggtttatttagtgatgtacgtattagcacccgacgcaatatnatgaatnacaagtgaatctgatacgctcacatgcctgtggactaggtgagccatttccaaaagaagtagcattagtcatgatgatttnacgattgaatacattattaaaaggtcattcaggtgccactttagtaattagtgagacaattacaattttttataaatgaacgtattataccgataatcccacaacaaggctctctcggtgcatcaggagatttagcgccattatcacatttagcattagcattaattggtgaagggaagtattgtacagaggggaagaaaaggatagtgacgatgtattaagagaattaaatagacaacctttgaaccttcaggctaaagagggtttagcattgattaatggtacgcaagctatgacagctcaaggtgtcattagttatatagaagcagaagatttaggttaccaatctgaatggattgctgcattaacgcatcagtctcttaatggcattatagatgcatatcgacatgatgtgcactctgttcgtaattttcaagaacagattaatgtggcagcgcgtatgcgtgattggttagaaggatcaacattaacgacgcgacaagcagaaatacgtgtacaagatgcatatacgttgcgttgtataccacaaatccatggcgctggtgcccaagtattcaattatgttaaacagcaattaga

SEQ ID NO: 123 - DNA (Genomic DNA), 1258 bp; single-stranded, linear
tttgtgcttcgtcaatcttgtcaccanctaactctaaacgctttccttttgtcgttttcgggntcccaccacaattaatctgttttgatttctgacatatcaatcttcctagttaacccaagccaaatctttaccatactcaatttctttaccttggaacaagctgtttttcttgttgagtaccacatatctacctttgacggtattagaactaagctctatataaaaatccaatgccattttataggttgtacataattgctttaaaacttcatatctagtntgataagaagtccatgacgtagtacgtaagccatcgtattcggtntgttcagaaacttcccaacctgtatcgctcaacacatctttcaatgcttctgaagttgtctttttctcaaatttgcctggtgcatacggtttagctgttgttatatcagcaagataagacgctatacattctatctctgtgtagccgtccatcgtatcttgaacccagttaataataaattcacgccattgtttgtttgaatcccttataataacacgatgtcgttcacggaacntttcagctctttctgatgatatgagcagttcaagcatttctgaattgtcattaacattacgtttatgaatcgctctaactaaggaaggatcatcagtagaaaggaaatctataatcttgtcgttaaaatctaaaacatgtatcacactctcatctcctttctataaatatctatcttgccatttaaccgtcgtatcaaagacgttttcaggttgtatgattaattcactgtacccagaatcaacattgaaataattacttccaaacgatttctcgctccaacattggttcctcatttgatgacaacacttnnngcttgnatatctattttcactaaatcacctttttgtataatgacatcccttgcgcctttcggnttcggtagaatctccgtattgaatgaacctaatccattcatctccatccacttataaccgtnatacttcgcactatagatagctatgatagaagctggacgctgataaaacttaccgccatctatccactctttctcatccatatcaataggtttacgtctatctgggtctttaatgtgatcaaatttccaagttttaatagaaaatttattacctactcttctgagccgcatataaacancgattctgtccaagttatacattatcggtttattctgatagtcgtatatctttttggggtctcctttttggttatacg

SEQ ID NO: 124 - DNA (Genomic DNA), 1620 bp; single-stranded, linear
tcgaatttggtgttgnccgttcctgtatnacattctgncttatctaatgggggacgttatgatgagtgcccacnnattagggatgatcgtncgagagtaagtgttggtgcaaggtcaagtgtgttcgcacctttccacaaanttagggttaatcatcattgatgaagaacatgaatctacatataaacaagaagattatccgagatatcacgctagagaaattgcccaatggcgaagtgaatatcatcactgtccagtcattttaggaagtgcaacaccatgtcttgaaagttatgcacgagctgaaaaagacgtttatcatttgctatcattaccaaacagagtgaaccaacaagctttacctgaaattgatatagtagacatgcgtgaagaattgagtgaaggtaatcggtcaatgttttcaaaagatttacgtgaagccatacaattaagatnaagatcgacaggaacaagttgttttatttttaaatccgacgtggttatgcatcgtttatgttatgtcgggattgtggatatgtaccgcaatgtccaanctgtgatatttcattaacgtatcataaaacgacagacttattaaaatgtcactattgtggttaccaagagacgccaccgaatcaatgtccaaattgtgagagtgaacacattcgacaagtaggtactggtactcagaaagttgaagaactattgcaacaagaatttgaagatgcgcgcataattaggatggatgtagatacaacctcaaagaaaggtgcacatgaaaagttattgactgaattcgaaaaaggtaacggtgacattttactaggtactcagatgattgcgaaaggattagattatccaaatattactttagttggtgtgctgaatgcngatacaatgttaaatttacctgattttcgggcgagcgaacgtacttatcaactattaacgcaagtggctggtagagctggtcgtcatgaaaaggcaggtcaagtcatcattcaaacgtataatccagatcattattcaatattggattgttcaaaaaaatgattatttaacattttatcgtcaggaaatggaatatcgtcaaattaggaaagtatccaccgtatttattatttggttantttcacaatctcacataaagaaatgaagaaggttatggaagcatcgcagcatgttcataaaattttattacagcatttacaagaaaaagcgcttggtactaggtccatcctccggcagcacttgcgagaatcaacaatgaatttagattcccaaattttagtgaaatataaaagtgaacctggattattacaagccantcagtttttagatgactattaccatgaaaaatttataaaagaaaaattagcattgaagattgatattgganccacagatgatgatgtaacattactaattattagaaacaagnncaagtattgtacgagtatttgaacccagtgtgtgaatatttacttnangnacaagaaaaagggcagaatatacaactgttaactatttaaattagcagtttatattctgtctttttatatggctttataacttacgtgattttggtttgataaggaatttattagtattttcatttac

SEQ ID NO: 125 - DNA (Genomic DNA), 875 bp; single-stranded, linear
aattgggcacgggtanacagttgtagcgttattaagnattttaacttttgcgaagttagcaacaatttnccaatgatgttattttatcaatgttacctcaagcagcaactacaancgattgcgttaccagtatcagctggtatcggtggtataaaagaattaacatcattagcagntattttaaatggtgtcattatttatgccctaggtaataaattcntgaagcttttccgaattactaaccctattgcccgaggattagcacttggaacnagtggtcacacattaggtgtagcaccagccaaagaattaggacctgtagaagaatcaatggcaagtatagctttagtgttagttggtgtagttgttgtagcagttgtgcctgtctttgtagcaatattcttctaaaacgaaaaacctaagcaagataatagcaatttgagccattgttattatcgtaaaaaaacgtctatactccagtttataactgggatatagacgtttttatgtatttattactttttactaggaatataaaactgtgcatgncgataatgaaatacgatgtcagacgaatcaaagggtttgccagtcattgtataaaaagtctggtggtaacgtaaacatggttcacctgtagacaattgtagtaatgaagcttcacttgaagtgagtttatctacattaaagaaaatatctgaaaaaccaatacgaagtttcatgtttgattctaaataatcgaagatagagcccttagcaatatcatcatttaaatatttcacgatttctttatgataataagaatattcgatacataaaacatcatcgtccacgaatcttaatcgctctaaatagtagacggtatcactcgtgcc

SEQ ID NO: 126 - DNA (Genomic DNA), 654 bp; single-stranded, linear
caactagtgattcaggatataggaattgtattgtcggaattcanacaggtggatatggtcaagatttaaaaagattataacttggcccaattatnacggngatcttgaaaacgattantggattagaacgaattcgaatttcttcaattgaagcaagtcaacttacagatgaagtaattgacgttttagaacgttcaacaaaagttgtgcgtcatttgcatattccattacaatctggttcagatacagtattaaaacgtatgagacgtaagtatacaatggatagattttcagaacgattaacaaaattgcataaagctttaccagacttggcagttacgagtgatgtaattgttggtttcccaggtgaaactgaagcagagttccaagaaacatatgattttatcgtaaagcataagttctctgaactgcatgttttcccttattctcctagaattggcacgccagctgcaagaatggatgaccaaattgatgaagaaattaaaaatgaacgcgtgcataaggttaattacgcttaagcaatcaactcggaaagttatatgcgtcttaaattggatcaaagatgtgcttgganggtnattccctgagggaacaagggtggacacaagaagggtacaattaggtggrrdctns

SEQ ID NO: 127 - DNA (Genomic DNA), 1443 bp; single-stranded, linear
ctancnaanggaanttcagcatccttaaaaatacctatttgactgtagaaaccttttgntgcgtacaatatctaaaccttgtcgtgctgctggaactgcacctgaacattcaacaacaacatctgcaccgtaaccgtctgtaattccattgatatacgtttttaagtctgtgtgttgtaaattgactacataatccatgtgcaatgcttctgctttatctaatctgacttngtggcantgtccaatccagttaccacaacaggtgcgcctttacttttcaacacttgtgctacaagtaatccgattggcccaggtcccattacaactgctacatcgccagagttcacttgaatcttagaaacgccatgatgtgcacatgctaatggttcttgtcatagctgcagactgatacgatacttccgcttctggaatatgatncaaactttcttcacgtgcaatgacataattagtaaatgcgccatcaacttgtgttccaataccttttcgatggttgcataaatgatagttttttgatttacaggaatcacactcattacanaccatagaatgtagtttcagaagtgacncggtcaccaactttaaaatcnttaacgtctgctcccaacttcaacgatntcaccagaaaattcatgacctaatgtcactggaaaattaacttnataatgcccttcataagtatgaaggtctgtgccacaaattcctgcataatgtactttaatctttactttatcatctagcggtgttgcaacttctttatcaagaagttctaagttgccatgtccttctcttgtttttactaaagcttccaccacaaacacntcgantttttanttgnaatagactnnatagnttnaagataagatagttancgatattnccaccttgatcaatacttganatttcagatgaaccttttgncatttgtacattcgtacctttcgccatatctgtgaaaatgggtgctacgtctgttgcaatatataatgaaattgcaatcataatcgtacccacaatgacagaatgaataatgtttcctcttgctgcaccaacaataaacgcgacaacaaatggtatagttgctaagtcaccaaaaggtagtacttggtttcctggtaaaataacggctaataaaacagtgataggtactaaaattaatgctgtcgaaataaccgctggatgacctaatgctacagccgcatccaatccaatataaatttcacgttcgccaaaacgtttatttagccatgttcttgcagactctgaaactggcattaaaccttccattaagatttttaccattctaggcattaagaccattactgcagccattgacattcctaaattaatgatgtctccaggtttgtaacctgctaacacaccaatacctaaacctaaaattaagccgacaaatatagactctcc

SEQ ID NO: 128 - DNA (Genomic DNA), 1103 bp; single-stranded, linear
cttagcaactcaagaaaacgttaatttatcaattcgcggaattcctaaagaagtagtagcacgtggtgcacatccatgtattatttctatggagggtcttgaaaaagaaggcgacacttatgtcattcctcatgtacatgaattattgacaccattagtttcagtagttgcattacaattgatttcatattatgcagcattacacagagatttagatgtggataaaccacgtaaccttgctaaatcagttactgtagaataattcacttttttagaatcaatcatgtattaaaattaaagtatatggcacccttttagattaatcgactagaagggtgcttttttaggtcgacttagcttttacttcatcttaatttggcagaaatgcgtnaaaaggaagtgttttatttatttaaatagtctgacaattaagggtgttatgttaatatgattttatgagaagtatggagtagcnatagaggggtgacctcgcatgttaattcaattaagatccacattgggcgantgaagcaaggaaaaacaattttaaaaaatatttcttgccacattcctaaaggtgataaatggatattatatgggttgantggtgctggtaagacaacgctattaaatatattaaatgcatatgagcctgcgacaactggcggtgttaatctatttggtaaaatgccaggcaaggtagggtattctgcagagactgtncgacaacatataggttttgtatctcatagtttactggaaaagtntccaagagggtgaaagagtaatcgatgtggtgataagcggtgcttttaaatcaactggtgtttatcaagatattgatgatgaggtacgtaatgaagcacatcatttacttaaattagttggaatatctgctaaagcgcaacaatatattggttatttatctacaggtgaaaaacaacgagtgatgattgcacgagctttaatggggcaacctcaggtttttaattttagatgagccagcagctggtttagactttattgctcgtgagtcactattgaatatacttgactcattgtcagattcatatccaacgccttgcgatgattatgtgacgcac

SEQ ID NO: 129 - DNA (Genomic DNA), 1095 bp; single-stranded, linear
ctgacatatttaatgtttacatctagtgcatcaggttacgccgtntgtatagcgatgttgagacgtttaactggattaactaatatcattggtaatttttanccaaaanatattgntngggtttaattggcccgagtacttttaccantatcatggttaantagtattttgntgtgactcnaggtgtaccncccaaaccgttgcatgctaatttaatgattcggactttaagcggacatatccaacatattgcatttggacctattgcatcacttgaatcaataaaacatcttggtacgaatggtggaggatttttagcaggaaattctgcaacaccttttgaaaatccaaatatttggagcaattttatagaaatgggcagtatgatgttacttcctatgtcaatgttgttcttatttggtcgcatgttaagtagacatggtaaacgagtacatcgtcatgcgttgatattatttgtcgcaatgtttttcatttttatagcaattcttacattaactatgtggagtgagtatcgtggtaatccaatactagcgaatttaggcatttatggaccgaatatggaaggtaaagaggtacggtttggagcaggtttgtcagcactatttacagttattacgacggcatttacaacgggttctgttaataacatgcatgatagcttaacgcctataggtggattaggaccaatggtattaatgatgctaaatgttgtatttggtggcgaaggcgtaggactcatgaatttattgatattnntcttactgacggtgtttatatgcagtttgatggttggtaaaacaccagaatatttaaatatgccaattggcgcccgtgaaatgaaatgtattgtcttagtctttctcatacacccaattttaattttagtattttcagcacttgcttttatgattcctggagcaagtgaaagtataacgaatccgtcttttcatggtatttcacaagttatgttatgaaatgacatcagctgctggcgaacaatggatcagggtttgaaggactgaaangaatgaatncaacatttctgggaaatatctctacaggaatcattaatgt

SEQ ID NO: 130 - DNA (Genomic DNA), 913 bp; single-stranded, linear
ggtgttgttttcctccaatttttggatcttttttgctctaaaatctcatcttttttaatctaaatagatcaagagtgcgctctaagttttcttctttttgaagaagtcgggtttccttgtctntgaagatcncaacgtctttctcgnagttctgcttcagtntgttctcttnggagttggtnttcttcttttgcntcaagtaatttctcttttttgatantgtcagcttctttatgtgcttgatnaacaatatcntcggcagtttgtctagcttgtgattgcttttgaagcancanatttcgggcnacaacataccctccaacaactcctagaatgatccccancacatgagtaggaggcttaataaattcacacacacacctccttttctaggggtttgctcctttaatatgaaatccaatatgactttatgaaattaaaaataaatcaaaccaaattaatttgtgcggtttaataggagataagtgtcaagttatcaatttgcacttttgcactatattgaatgctatttctactattttctaaagttttgaagctcgattataaaactattgataatgtaataataaataaaataaaaaaccttatagtctcgatttgtagtgtatcccataaagttagatattattctagctttatgagatgaatatcactttcaatcaatcctataaggatatttgctaagtttaactatagatataaatttgtgtactattcttcgtcaaataatgactttggtgcatcttctgtttcttcaacatcaccatcagatatacctaatttttctctcaatttacgatcaatttcttctttaatttgtggattttctttcaagtacattttaacattttccttacctngacccattcgttcgccatngcaagaataccag

SEQ ID NO: 131 - DNA (Genomic DNA), 970 bp; single-stranded, linear
tgangtaaatttggttgtggctcantcgcatctgcgaaagngnagtgcccngagaccgcctgtaatgttcatgacgaccctagaataataataaactaaaagcgccgcctnatgaaantgagcgccttggatgnaatcactccaaacggacaccntcgaanccacctngagatgtanangaaatacatagtaaacctacgagtgatccancgatataagggttcatgtctgatacagatgtgattgctaatgttggtaagtagataacaattgcaacacgccctaaatggtaaacgacaaataataatgagccantgacacgtatgctagggccaaatctagcttctaaatattcatatgcagatgttacctttaactttttaaagaaagggacatagaaataaataagtaatggaataattgcgacgatagcaatgttaccagcgatatatgaccaatctgttaaaaatgctttcctctggtgtagacataaatgtaatcgcacttaacgtagtagcataaattgaaaagccaactacccaagatggcaagcgaccacttgcggtaaagaaactattggtactttggctcgcgcgcttggtaaaataaacgccaatgaacaacatagctagtagataaatgataacggcaacccagtttagtgtgccaaatccaacttctttcatgggcaacatcccctttacaatgtattgattctttgatgtctataaatcgtattttgcaatgagttgatctacatgttcgtcgatgtgcttcgttaaaaggtttgaaaggtcttttcggtaatcctgcatcaatgtcacgatgacgtaatatttctttcaatgttggataaatccccatngatnacaactgtttcgataatgtcgtttgaatcatgttgtagttggtaagcttcttgaatttgaccttgtcgtgctaagtcgaaganttctctagcgctcgtgcc

SEQ ID NO: 132 - DNA (Genomic DNA), 791 bp; single-stranded, linear
gaagacatgaacgcatacgaagatagttatgaaaaccgaactaaaaaaacaactgctggcagtagcgatttaagtatgtaattaacgagggcattagccctctatttttgtgtacaaaataacgataaacgaggtatttaatatgactgaaacaacttttaatccaattacatcattaacaattaacaatgaagaagtgaaagcaaaagcaacatttatgttcgataaaaccgctaaaaaatttgcaactgaacaagaagataacaaaggtagaaaacaaacgatttcaggatttactaatgtttatnacgctttattagaacgtgacacagtggcaatcgtagacttttgggaatgtgcaacagcttatctaggtaaaagcgcgcctaaaagagaagatattgaagcggaaatcatggaaatcatcgaaagagaaaacgacacgttgatcttttacaaggtgcgttggacgtaatgaataatagcggttttttcaagcagaaatcacgtctattctggacacagatgaaccaagcgccatcgttagccaaagaagacgagaaagagggcgcgaaagctggtatcgagatgatgaagaacaactacaaagaaatcatgaccgtagcaccttattagactattcggaaataaggcagatgacaagtcgttacataggttatatgagtaatgacgagctaatgagcatgctacctgccgaatggaatgactggattattggcgctagacaagcattgattgaccaaagggacntcgctcgtcccgctcgtgcc

SEQ ID NO: 133 - DNA (Genomic DNA), 820 bp; single-stranded, linear
ggcacgagctaaaatatatgaagctaaaggccgtccatctgacaatccgcttattgttcatatacacagtaaagttcaattaaaagattttacatatactttggcacgagcgtagaaaagttaatgcaggcattctggccgggccctatttcgtttatattgccgctaaagccaggctatctatgtcgaaaagtttctggaggtttatcatcagttgctgttagaatgccaagccattctgtaggtagacaattattacaaatcataaatgaacctctagctgctccaagtgctaatttaagtggtagaccttcaccaacaactttcaatcatgtatatcaagatttgaatgcccgtatagatggtattgttcaagctgaacaaagtgaagaaggattagaaagtacggttttagattgcacatcttttccttataaaattgcaagacctggttctataacagcagcaatgattacagaaatacttccgaatagtatcgcccatgctgattataatgatactgaacaggcaattgcaccaggtatgaagtattaagcattactcacccaatacaacacttacaattattacagatattgagagcaaaattggaaatgacggtaaagattggtcttctatagcttttattgtgccgagtaataaggtggcgtttataccaagtgaagcgcaattcattcaattatgtcaggatgacaatgatgttaaacaagcaagtcataatctttatgatggtgttacattcacttgatgaaaatgaaaatatttcagcggcgtatatatacggctttgagctcgtgcc

SEQ ID NO: 134 - DNA (Genomic DNA), 1107 bp; single-stranded, linear
gtgacttgaaagatatagtatatcggatttgtaatgcgccgttaatcaattatgatgcgattaagatgacccgacttaaaatacncagtccgacacaagattgctatgagttttttgggtggagatattgaattatataattatcactattaatacctacatcaaaggtatgctattgatttagttattaaagnaaatcataaaacatataagaatcaaggaaaagtaaatactgattatttttgttttggaaaagatatcattgcgccagcaaatggtacagttgaaaaagtagtgaatggggttcaagacaacagtattggaagtacgaatgaatcacagtttttaggaaattatattgtaattaagcacgcagaaaatgagtatagcttaatagctcatttacaacaatattcaatcattgtgaatgaggggcaaaatgttaaatatggtgacttccttgggaaggttgggaattctggcaattctactgaacctcatatacatttccaagtaatgaatgataagaatattgaagcatgtacgtctttgaaaattcgatttttaaataatctagaacttatcaaaggggatgtggtctgcggattacaaggtgaatgatggcgatacttataaaatctcgacactataaaaatggtatagtgtcgagattttcttgcttatttagttaattcaaagtgtacgccggattcattagaagttgatgtatttgtgtttgtaatagagtatccagttattgaaattttagattcaatatctgaagcggtatttgtagattcgggattatagaagctacattcataagtgttatcatctntggtnttcnaagaattaaacattccctttggcttttaacttccgactttagtggtgggntaatgncaaaaagtntggagntgcttattactattaattaacaacccagcccaattgggncaccccccaacggatttggaccaatcctcaacttacctgcttatgaatccctggctcccaacccccgcaaatttgctaaacccaaaatccacttccaangtttccaaacttactttcttccaagntaatttcttcaaggattttttttgg

SEQ ID NO: 135 - DNA (Genomic DNA), 1135 bp; single-stranded, linear
aagtttgatccacccaccntaaacccatcgcctaacaataaanccgaanntcacctcctgcctgttgatccaattgttcccattccaataaccgccacctctttttctagaacacccacacctatcgttctatggttaatatgttcgacatctgtatgcggtatagcgaccgaacatagatgtgttggtaaaccagtancnaattctttttctctgtcgatgactgcatctttaaacgttgacttcacgaacccattttgaaataacacatctgacatttgngacaatacggattctttatcagttgccgacnaattgagcattatattttctttatgcacctaattgcttgtcccatccattttccctcgcttctttatttgaataattttttaaaatctcatttacatcagaatttttgcgactttgtatgatgcgcttaattgcgtcattgtcttgcgccacatctctcaattgtagtaacgctcttaagtgtgtcactttatcaacagcagcaataggtacaataatatggattgctgtgccatctgacatgtatattggttcttgtaatatcaacatactcatcgctgttttatgtacatgcttttcagagtatgcatgtggaatagcaatattttgcatgataaccatatacgaatcancanataccngggaattccatctcatgaatatatttaatatcaataaaatgattagcaactaacacagcacgngctttagcaatagcttcatcaatattttcaacaggaggcntnctttncacgggcctggccggtatcaaggcagctaaatctaatgtcttattttgtgtgacaatcgatccattaatggttgaaattgaattataattggcaataaaatcttctaaaccatcacgtagttctgtaatgtcattaactgtcgttgtgcgttcaattaatgccattaacttgtttatttccttatcaatgtcagccgattccttattaatgtacttcatcacttctttacgtaactttcgttgctcattttcagataaagctacttttgtgataaataattttttatgtgttaggacaaacattggtgaaaagacgaagtcataatctaatgtgtaattttcaaatgttct

SEQ ID NO: 136 - DNA (Genomic DNA), 973 bp; single-stranded, linear
cgtgcgagctgcttttggtaaaaacggcggtaatatgggtgtatctggatcagttgcttatatgtttgatcatgtggcaacatttggtattgaaggaaagtctgttgacgaaatacttgaaacattaatggaaccaagatgtaagatgnaaatgatgtgattgacgataatggattgacaatagtctatgcttgaaccaagatccaatttccagtcgttccaagatgcgcttcgtncaccaggttgttggaagaatttaaaagttgcttgaatttgaaattgttaccctccaaacaagatattgaactttctgaagcggaccnaagtaacatttgaaaaattaatcgatgcattagaagatttagaagatgtacaaaacgtattccataatgtggatttgaaataatgaaatcagcagaacaatggattgatgaattgcaacttgaatcacatcctgaaggtggtttctatagagagacaattcgagaagtattgaaagatggacgcagagcgccgtttagnagtatttattttttacttacagatgacaatatttcgcattttcatcgaattgatgctgatgaagtatggtactatcatgctggtgattctctaacaattcatatgataaatccggatggggaatatacgactgcaacattgggtactgatatccaaaatggagatgtattgcaatatgtagtgcctaaaggaacaatttttgcttcttcaatcgaaatttcaaatacttatagtttagtaggttgtatgtgtcaaccggcatntgagtttaagcagtttgaattgtttaagcaatctgaattaattacacaatatccgcatcttaaatcagtgattganaaatatgctttaaaataaaaatgatcaatgaagtggtttgaaggttgttaataaacctttgagtcacttcatttttatatgtattcttgattgaatcagaatagatttgatg

SEQ ID NO: 137 - DNA (Genomic DNA), 1701 bp; single-stranded, linear
ggcacgagctggttgcatatctaaactttggtaatctacaccttctttagatttaccgaatgcgatagctggagacttaactgcggctactttcgcatgtggaatagcaatacctcgccgataccagttgtactttgtgattctcgattgtgaatcgcttccttaaatgacgcgacatcacttaatttacctgccttgnctaattggaattacctaactcatcaataacaccatttttgtcatttgccantaaatccattgctatcgtatcttttgttaataactctgttactctcattattttcactccccatcaagtacgctaatcgnaacttggtgattctattttttcttatagcggtcccgtgtttgctaagtcctcaatcaaaatgccggggcaagtaccgcaatgcgactgcttggttgggaatgctttttcaatcgttaaacctggaagcaattccagccaccatgcctgcaactgtactatcaccagagccaactgtattaaccactttcccttgtggattaactgctttaatactgatttctttatcaatataaatagcaccatcaccgccaagcgagacaataacagattgcgcacctttatcaactaacaaacgaccatatttaataacatctgtgtctgagttcactgttgtattaaacatcacttctaattcatctttattaggtttaataaatagtggntgaaatggtaaaacgctttcaagccaattctttttcagcgtcgaccgactaatttagcacctgtctgtgctgtaatttgtgcaagtttgcgcatacgcatcgcttggaatacnacttggtacacttccagcaacaataacgatatcntcgcttgttgtatttttaatgtgttgtaacagttgttcaaattgtgttgacgttatatgaggacccggtgcattgatttctgtttcttgtcctgtttttaatttcacattaatacgtgtatcttcatcnacnncaataaaattcgattgaattgcnctgttanttaatgtatctataatgaatttcccaggaaatccacctgcanatcccaaggcagttgactcaacatctaatgtctttaagacggcgcgagacgattaataccctttcccccccagcgaagtaatatgttgctgttgctctgtccaannccatcaaggttnagaatcattcgtaaaaatgacataagtcaattgtaggagtgngagtcncctgtataaatcataaagtccctcctataaagtgagacttttgttggtattcttttancgagtcttgagttaatgctttttcagatgtgatgantgtcgtactttctagcacagggacacgagcacaatatactttattaaacttagantgatcctataagnacanatgantgagtggctaatgacattgctgtttgtgtaactaatncctcttgctcatcgggagtagttaatccaagttcaatatctaatccattcatcccgataaaagctttatcgnaacaatatcgtcttaatatctccatagcactaganccaatcgtagcnagtgtattttctttaacttgaccacctagcataattgttttaataccttttggaagtaaagcttctacatgtgttaaaccattggttaccacaatgatatctttcgcttgaatatatttaattagcggcacgagctcgtccc

SEQ ID NO: 138 - DNA (Genomic DNA), 858 bp; single-stranded, linear
cccggtgtaaaccgtatggatggatgctagcaccaanttaataatcctccacaatancattaagggtattcatgtaggtgncacaacatggtaaaggctctaccagttgcttaccttagaacagctttaagttgnaaatggttatgaagtaggtacatttacgtcgccgtttattgaaacatttaatgancgaattagtctaaatggtgtgccaatatcaaatgacgctattgtagaattagtatcacgtattaaaccagtaagtgaaatgatggaacgtgaaacagatttaggtgttgcaactgaattcgaaataatcacagcgatgatgtttttatattttggtgaaatacatcctgttgattttgtcattgttgaggctggattgggtataaagaacgattcgacaaatgtctttacaccggttttatcaatcttaactagtatcggtctagaccatacagatattttaggtggtacttatctagatattgctagggataaaggcgcgattataaagcctaacgttccagtgatatatgctgttaaaaatgaagatgcattaaaatatgttcgctgaacgcgcaattgaacaacatgcaaagccaattgaattagatagagaaattgttgttgtatcgcaaaaatgatgaatttacttacccgntattaaagattatgaatnagaaacaatcaatntnaagcattgttagggtngaacatcaagaaacaanatgctgcattagccataacaantcttattggantcaaattgaacaaggattaattgaatncagatttncaanaagatgatagacgggtttgatcaagtccgtggacntgncgttttgggcaggt

SEQ ID NO: 139 - DNA (Genomic DNA), 497 bp; single-stranded, linear
gaattcnaagtcactttcttttttaagctttaaatttctccccatttttttagccccctataaggattgaatatcaatgccttctntcattaaaatttctctaatttgcgaaacaaataataatgcatgttctccatcaccatgcacacaaattgtatctgcttgtaacgttacttccttattgttttgtgaaataactttattttccnncaccatctttaaaacctgcttaagtgcttcgtcagtatcagtaatcacagcatcactttcttttctgattgataaaatcatatatgttcctataaacactaaaaatcctataactaggtaataatattaaattcaaggatcgancctccgctaagcgacaacaacaatggtgacaataacaacaacaactgagaattnaaatacctaattcaaaaaggggtnatnggncttacaatgaatgtggccnaaaattggggaggntccaaggngggntcaaattrrdctns

SEQ ID NO: 140 - DNA (Genomic DNA), 969 bp; single-stranded, linear
ccctggttgattggaaaatgtaattgaatgaaacgggtaaaaccttccccaaagcaccataattgttgcaagtaggttgccaccccaatcctggtttaccctgatttgaaaggctttgggcaagccgaaatatagatatctctaaccgacgagatttataatttgatgatttatcaattaggtgcattacaagggttttgtcgcattcatcaacttaaaattaatcatgttaaacccgcatggtgcattgtatcagatgggtgcaaaagacagagaaatagcaaacccccgtnatancacnacctgttnatgncnttgatccatcactagtgttagtaggattagcaatcatatctaatttcagaagcaaagaatgtcggatataatccagcttctgaagtgtttgctgatagacgatacgaagatgatgggcagctcgttagtagaaaagaaagtgatgctgtgattactgatactgacgaagcacttaagcaggttttaaagatggtgnaggaaaataaagttatttcaaaaaacaataaggaagtaacgttacaagcagatacaatttgtgtgcatggtgatggagaacatgcattattatttgtttcgcaaattagagaaattttaatgaaagaaggcattgatattcaatccttatagggggctaaaaaaatggggagaaatttaaagcttaaaaaagaaagtgactttgaattcacaaaaaatcataaaaggttattattaggttctgtatttcacgatggcaacttctgcaattggcccagcatttttaacgcaaacagnagtatcaacatcacaatcgtttgnaagtcncgnatctgccatatnactgtctatcatcattgacattggtgcacaaattaatatatggcgcatatnagttgtaactggtttaagaggtcaagaaatatcaaataaagttgttcctgggcttggtctcgtgcc

SEQ ID NO: 141 - DNA (Genomic DNA), 632 bp; single-stranded, linear
ggnacgagcggcacgagcgcacttattttatcagaacattctaaaaagaatatattcaatataaaaaaggctgtgtaggggtgtcttatgaataatagaaatgtgtatgatatcgaagtaagtgattataaaggcttaacttataaattagaagcatttagaggtaaagtgattttagttgttaatactgcaacagaatgtatatatagcgaacaattgaaaaaactagagactttgtntcaaaaatataaggatcgtgggtttgtagtgttgagttccccgaataataattgtgacaatcgacaaccaggntctaatgaagaaatcttgaaaattagncggngagaaatttgggtgttacatttccagtgctagcttaaaatatcttgtgaacgggaacgaatgaacatccccgntatttacgcatttnanaggaatgaacaaaccaggaatcttngggcccccaataaaatggaatttcacaaaaatttataatcgatcgacaaggcaatgttgtaaatcgattcttgccaatggaagatccaatggatatatcgacaaatatagaaatattattggaagaatcttcaatcttaaatttaanattgagcgcttagtntgcaaatacacaa

SEQ ID NO: 142 - DNA (Genomic DNA), 662 bp; single-stranded, linear
ccccacnaagtacncgaaacgcaaacaaacatcttaaaaggaggaacgaacaatgcaagcattacaaacatttaattggaaagagctaccagtaagaacagtggaaattgaaaacgaaccttattttgtaggaaaagatattgctgaaattttaggatatgcaagggcagacaatgccatcagaaatcatgttgatagcgaggacaagctgacgcaccaatttagcgacagcaggtcaaaacagaaatgtaacgatcaatcaacgaatcaggattatacagtttaatcttttctagcaaattagaaaatgcgaagcggttcaaacgttgggtaacttcggaagttttaccaacattaagaaaaactggtgcttaccaagtacctagcgacccaatgcaagcattgagattaatgtttgaagctacagaagaaacaaaacaagaaattaaaaacgtaaaagatgatgttgatngatttgaaagaaaatcaaaaactggatgcgggagactacaatttcttaactagaactatcaatcaaagagtagctcacatncaaagactacatgcgataacaaatcaaaaacaacgtagcgaattattcngggatattaattcagaagtgaaaaagatgactggtgcaagttcaagaacgaatgttagac

SEQ ID NO: 143 - DNA (Genomic DNA), 960 bp; single-stranded, linear
taattcgcaataggagtgatgaatatcataaattttaccctccaaatgaagctaatgaagtcctggacccgagtaagacgcatgtagccaagctaaaataatccactctaccttatctttagttaataatgttactaaatgttgttcatacgctgcttttgaatcaaattgttttggttcattaatataaacaggaatatcgtgcttgtttgctctatctatacaaaacgcattttgatgatccgtatatagcnccgtaacttcaatattttcaagttttcctgattcaacatgctcaactatattttcaaagttacttcctgaacctgatgcaaaaatcgcaattttaaccattgttatacccccaacaattcaattgcagttgactcatttttcacaatatgaccaatttgataagcttccacattttgttctgctaaaatcttcaaagcgcgtcgatgcatctttttcatcaacgataaccgtatagccaatacccatgttaaaaatgttatacatttcatttgtgtctatattgccttgttgttgtaaccaatcaaatatttttggcgttggaaatgatgtagtatcaattctagcagcatatccggctggcaatgcacgtggaatattttcataaaaacctccaccagtaatatgattcattgccttaatagaaacttctttttttaaagcaagtacaggtntgacatataatttagttggctctaaaaagacatctataaatggacgattatcgnagggtgatgccaaatcaatgnctgattcantaattaatntgcgcactaaactgtntccattngantgaatgncacttggacgcaagtcctataacaacttggccctcttncaattcttgaaccatcttacaatagncaacctttttcaactgctccaacagcaaatccggctacatcatattcaccttcgtgatacatt

SEQ ID NO: 144 - DNA (Genomic DNA), 1013 bp; single-stranded, linear
taatnaatttggcgantcacttgtcgctaagtggctccaccttgtcatctattattgcatcactcatgggncgnacatcatagtgttgatttgattcagccatatcnacgttttgatttttctaatagaagatcagcaacaacatcaacatttgaatgattcatatatgatgcaggtacgtcttttaatgttttaatgttatcaatataaagattgatgtagtgttgcgggatattgtagtgatgttcaagtaacatatcagtaacaagttgattaaagacactttcatctaattcaccacgtgccacagcgctttctattaatgctttatttgggaaaataggcacgagcgaacgtcacgtaaccatttngcgacatcttcaaacgtatccgcttctaatccttcccaggggttacgtgctgcaaaaatcgaaatcggtgataatggtgtaataacacgtttcgcattttcaatgactgaattgatatttaactgtgttgtcatacctttcacctcctataaatacttcttcaaataattcggatgactttctatcgctttcgagcgtgcttcacctagattaactaaccacacgtacaataccgcaaaacccttagagtatcgatgacgcgccacccaaatacttaataaactgccaaagattaaaatgacaacactaatgatgacactcactgtaggcggtgttgtcgcatgtgttgttatattttggtaatacatcgtaaaaataattgtgtgtgatgacgtagataaatgtcacaattgcaatcaaaatcatgccaaccagacgtgccatgcgccctttactaaaggctaccatctgattccaagatacaagttaatgaccatgctagaatgagtgcacttaacacttcatatgcacttctgtcactaccatccaaatagaatgcacgataatagctaatacacgtccatgacatccagcataagctcttacaatgctgttttgaatatgatcgctcccaarrdctns

SEQ ID NO: 145 - DNA (Genomic DNA), 1032 bp; single-stranded, linear
atccacccatnacgntactcatancattgtcaacagtaagtaatgtccatatgcatatcnatnccgctcggcantatancacccaaccggatttcataagtgggcggataaagtgatnagagtgatctcaacactatcgantagntaccagcgttctttatcggtnttattttatnatttattgtcacanatttantgaatatagatagcgttatactaagtcagnttatattacctgtaatcacgctatctttaggtatgtgtgcatacatcattcgtttagtgcgttctaatttattgatgttattgcaaagtaatatcgtacaancagcaagattacgcggtatgaatgancgttatattttaattcatgatttactaaaaccaacaattttgccgattatcccattactagggatttcacttggcagtctaataggtggtactgtagtgattgaaaatttatttgataatacctggtattggttatctattaatgggatagtattaaatctcgagattatcctgttattcanggatgcgtgttatttattggcttcttcgttgttattatcaatacgattgctgatttattaacgttattacttgatccgaagcagcgtttacaattaggaaatcccacaaaacacaaccaatacaccattgatatcagaaagtagtgnccgtcatgcataaaatattttcanagaataacctgatattttttgtattcgttgcatttatttttgtggtaattgtactgcaattctttgtcagtagtgaaaatgcaaccacagtcaatttatcacaaacttttgaaccgattagttggttgcatttattaggaactgatgattatgggagagatttatttacccgaattattatcggtgcacgttcaacattgtttgttactgttttaacattaatagctatcgttgtcataggtgttacactaggtctatttgccggatataaaaaagggtggattgaacgattagtgttaaggtttattgatgttggtctaagtag

SEQ ID NO: 146 - DNA (Genomic DNA), 646 bp; single-stranded, linear
ggcacgagactttggtggtagttttgaaagattacaagcattgacaacaaaaacaacattacccgtattatccaaagactttataataagaccccccccaanttgatgttcctaaaccnagctggtgcatctatgattttattgatcgttaacatcttatcggatanacaattgaaagattnaatataccctacgcaatatcccaaaatcnagaagtgttaattgaagtacatgatccccatgaattagaacgtgccnatanggttaatgctaaattgattggtgtaaataacagggacttaaaacgatttgtcacaaatgtggaacatncaaatactattttagaaaataaaaaaccaaatcatcattatatttctgaaagtggtattcacgatgcatctgatgtaagaaaaatcttgcatagtggtatcgatggcttactaataggtgaggcgcttatgcgttgtgacaatctatctgaatttttacgacaactgaaaatncnaaaggtgaagtcatgatgaaattgaaattttgtggctttacatcaataaaggatgttacagcggccagtcaattacctattgattcgataggtttcatccattatgaaaaaagtaaaaggcatcaaacaatacccaaataa

SEQ ID NO: 147 - DNA (Genomic DNA), 565 bp; single-stranded, linear
ggcacgagcgtcagtccaaatcacgccttgtggtttctctggaattgtcatctattactcacccccaaatacatcattaatgttaatattgtgaattgcttcaattggatttattgtttcatctacagnncgatatcgcttactatcaatcatgncatctacatgacataccgattgataactacaaaaagcacatggcaatttgtgtgtgtnctttaatggtgcaactncagtatgtccatccataatatntgaagctgtntctataaaattctctntgttatgctgaatgaatttataaattgntggttcatctgacacttggctggctcgtttactcaaagagacatcttttattcaanccaactgggtacaaatatctgaaggtgaanttagggttcttnaacgaatttccaatgcatcaaatagcaggggggtcttgcattcaactaaaccctcaggttaancttnnnaattaatcttgntcttggntntctttcancaatatcaagaccatgatttaatttactcttgggccaagtcatggagttttatatccaccggg

SEQ ID NO: 148 - DNA (Genomic DNA), 919 bp; single-stranded, linear
cttgaagtagtagggttacaaggctcaacttaccttttaaaaggaccaaacggtgaaaacgtaaagttaaaccaatcagaaatgaacgatgatgatgaattagaagtaggtgaagaatatagtttcttcatttatccaaaccgttcaggtgaattatttggaactcaaaatatgcctgatattacgaaagataaatatgattttggtaaagtacttaaaacggatcgcgatggggnacgtatagatgttgggtttaccccgngaagtgttagtaccatgggaagatttaccaaaagtgaaatcactatggccacaacctggtggatcatttgntagttacattacgaattgaccgtgagaatcatatgtatggacgtttagcgagtgaatctgttgtagaaaatatgtttacacctgtacacgatgataatttaaaaaacgaagtcattgaagccaaaccttggcncgagcgtattacgaattggtagcttcttattaagcgaatcaggttacaaaattttcgtacatgaatcagaacgtaaagctgaaccaagattaggtgaatctgttcaagttagaattatcgggcataatgataaaggtgagttaaatggttcatttttaccacttgcacatgaacgntttagacgatgacggccaagtcatctgtgatttactaggtgaatatgatggggaattaccattctgggacaaaatcaagccctgaagcgattaaagaagtattcaaatatgagtaaaggttcattcaaaacgtgcaaatcggncacttatattaaacagaaggattattaatattaggaaacagggtaaaaatcacttttaacttaaaaaagggttggcgggtcgnntttggnctcaaaaagaattaatcattntnacaacgnnntcggnggatgcg

SEQ ID NO: 149 - DNA (Genomic DNA), 955 bp; single-stranded, linear
ctgcatctggtgaaggaaatcaantanntnttatnnctgaagtgattgcatggtgcaacntcaaatatcacatatggctcagtggantatatggataaaggcttaacaggtcatatcatgcggcgtggtattactgaagcggatgcctcaattaattgggcactaggtttaatgaatgagggtagccaaattattgataatacaacaaatttatgtggtgatcgcacaacaagnncacttaaatcaggaggtgnaggtacaggagaacaaaaaattaatctaacatctaaantcgcacaaatatggtaaagaaacagatggttatntccttaaacatggtgttatgaaagaacatgcatcatcttgtattttaatgggtatccggctacattangcatggggggaactaaatcaagtgctaatcaggaatcacgtgttattnatgttatcttgaacatgctcgggggngacgcgaatcctattttatttaattgangaagatgatgtacaagctggtcatgctgcatcagtaggccgtgttggatcccagatcaacttttactatttaatgagtcgtggtatttctcaaagagaagcggaacgtcttgttatacagggtttcttagatccagtagtacgtgaattacctatcgaagacgttaaacgtcaattgagagaagtaattgaacgcaaagtttctaaataatattttgaaaataaaagtttgtaatagatatagactgtcgatattggtataagactaatacaacgtcagtatttaaatgattaggatttttatttaagaaaggtcgtgaatgaagtggccgaacactcatttgacgttnatgaagtaatcaaggattttccgatattagatcaaaaagtccatggcaaacgtttagcatatcttgattcaacagcgacaagtccaacgcctatgccagtgttaaatgtt

SEQ ID NO: 150 - DNA (Genomic DNA), 462 bp; single-stranded, linear
naaatttcctatacgttatactttaattgttaataagccacataaataagagggggaaatgctgtgtacaagcaaggtgaaccaaatttatggactggaaggttagatagtgaaacagacccgaaaaaatttagacattttcaaacagtaacatttgaagatttgtctaagctggaaaagagtagtatgccatcaggggtcggtatattaggctatgctgttggacaaaggtgttgctttanacaaggggcgcattggtgcaaaagaaggaccagatgcgattaaacaagcatttgcaggtttggcggatttggatcactgtgaaactntagtcgattacggaaatgtttntcatgatcatgaggaattanctngatacncaaccangaatttggtactgtnttggcaaattgagctctntctttagagcttggnncattgataggttctctcgcaggtggt

SEQ ID NO: 151 - DNA (Genomic DNA), 752 bp; single-stranded, linear
ggcacgagcgtaagattaaccattgaccataatatatattgtgtttttccaaaatcggctctgctaattttaaataggggcgatatattgttataaaactattgaaaaattcttgtgatagcatagtgacatctcctaagacaaaatagttagcttagctaacctttttacaacaatagtaattataaaacgggagcaattagaaatcaatatataattattaagagcaaaaataattatactttgttaaaataagcgtaattacatgtaaatagggggatactaatgatattgaaatgtgcatcacatcactcattatatagatcagttagatcggtttagttctccaggagatgttataaaatnacattcaggtgggtatcatcataaatatggaacattcaataaattaggttatatcaatgaaaattatattgagctactggatgtagaaaataatgaaaagttgaaaaagatggcaaanacgatagaaggtggagtcgcttgcgctactcaaattgcacaagagaagtatgagcaaggctttaaaaatatgtgtgtgcgnacaaatgatatagaggcagttaaaaataatctacaangtgagcaggttgangtagtagcgccgactcaaatggaaagagatacacataaagatggtaaggtaaagtggcaattgcttatattatgaatcaggatgatgatgaaattacgcaccattttttattcaatgggagaaagtgcctccatgc

SEQ ID NO: 152 - DNA (Genomic DNA), 791 bp; single-stranded, linear
caaatgtttatcatgatatgatgaatataataatcgggtatataactgtatgattaattacacaataaagagagggaatataatatgngnnaagtgtcaattaaagatgttgctagagaagctggtgtatcagttncanctgtgtcacatattttaaatcataatgatagtcgtttttccgcancaccgataaaaaacgtacatgctgttccagaacgtttaggctatgcccctaataaacatgcaaaacaagctcgtgcgcggcagtaaaattcaaactattggcgtcattttacctagcttaacaaatccgtttttctcagcactgatgcaaagtattcatgaccataaaccatctgatgttgatttatgctttttaacatctacagcaactgatntgtatgacaatattaaacatttaattgatcgaggtattgacggattaattatcgcacaatacatatcatccccggacgccctaaataactatctaaagaaacatcatgtaccttatgtcgtactggatcaaaaatgaccatcaaaggctatacagattgtgntccggacaaaattgaatatcaagggtgggacaactttggcagcacaacaatttaatagaactcgggtcacaaaccatattgataattggttgcaaccatattgacaatgatggngaatattgtcgactcctgtcgctggatttgtcgatactttgcgcgcgaatcaattgccagaaccacaaatcgtccctactgaattatctaaacgccgtggctaaccatgttgaatga

SEQ ID NO: 153 - DNA (Genomic DNA), 1314 bp; single-stranded, linear
tttgtctttggaatgggctcgttttttttaacctaataagaaatgatagggcatttgagattggaaggncattttggctttgtgcaaataatacaataagctaaatgtctntttttgtttttgtgaaaatatgatggatggcttgtgtgggcaagtttgctaatttaataagatatgcatttttcaatttaggagttggccatgcatctacactttataatggtgagagcgtggtgaggtattgttaatcacgcaattgtagcgaggagttattgctacatatgtcgttatggcctattgattttctaaaatagctgtatcagatcatgtgacnaaataaaaataatttgttgaaagcctttacataacttgtctagacaagttatactcgttttaagacattaagggagtgaaatatatggctgtaaaaagagaagatgtaaaagccatcgtaagncgctattggggganaagaaaatcntgaagctgcancgcattgtgtaacncgattacgtttngtgcttaangatgaaancanagttgataaagacgcattaaggaacaacgcgttggtcaaggggcagttcaaagcagaccatcaatatcaaattgtcattggtccaggancagtcgatgaagtgtataagcagtttattgatgaaacaggtgctcaagaagcttcgaaagatgaagcgaaacaagcagctgcgaaaaaagggaatccagtacaacgtttgatcaaattgttaggggagatttttataccaatattacctgcgattgtgacaactggtttgttaatggggattcaataatttacttacaatgaaaggtttatttggtcccaaaagcacttattgagatgtatcccgcaaattgctgatatttcaaacatccattaatgtgattgcgagttaccgcatttatttccttaccancattaattggttggagtaatatgctgtgtatttggtggtagtccgatcctaggcatagtcttaggtttgattttaatgcatccgcaattagtatctcagtatgatttggcaaaagggaatattccgacgtggaacttatttggcttagagattaagcagttgaattaccaaggtcaagtgttgcctgttttaattgcagcttatgttctagctaaaatttgaaaaaggattaaataaagtcgttcacgattcgataaaaatgttggtcgttggaccgtaacgcttttagttactggatttttagcatttattatcattggaccagttgcattattgattggtacaggtattacttctggtgttacatttatattcc

SEQ ID NO: 154 - DNA (Genomic DNA), 972 bp; single-stranded, linear
ataattattgntggaaaataacattgagcccaattcccaacagtggccgacattttccatccatttacccccccgtgactttgtatccgaatttcnaccntccaccnaagttgncatcaatatgttaataacccaaatcccaaattggaaatattttgccaagccaagttttgatgatgcgcatttgtcctaatattttccacttaacaagatccgacccccagccaagaaaatacatcaactgagaaatataatgnccaagactggtttccaacacacattcgacataatgagttgtctaaattgactgagcaacaacttgtgattcagttgcttatgcatatgattcattatggcacgagcgtacatatcattcgaacccaaagtatcttaaatgatgataaagtgaatcaagtatgcgactatatcgagttacattttcatgaagatttaagcctttcagaattaagcgaatacgttgggtggtcagagagccatctgtctaaaaagtttacagaatcgctaggtgtaggattccaacatttcttaaatacgacgcgaattgagcatgcgaaactcgatttaacatacacagatgaaacgattactgatattgcattgcaaaatggcttttcaagtgcagcgagctttgcgagaacatttaaacactttacgcatcaaacgcctaaacaatatcgaggtgatcgtccagcaatcactgaaaatcaacaatcggcacaacataattatcacgaccgtgaattgatattacttttaaatgactacattgaagaaatgaatcaattcaattgaagatattgaaaagntgaacttataaagagattgccttnaaaccaactaatcaacaactaaatccaattataatccatattattcaagttgggctatttgaggaatttgctccaatacacagtatcaatccacagttgcttacatgttcatcccatgatt

SEQ ID NO: 155 - DNA (Genomic DNA), 503 bp; single-stranded, linear
aaaccattttccaaaaccaagctgggcatccaagttttcctattgtaatctgcaggtaaccaagggaatgcttccgtgaatttaggtggtagcgtaacatctattcaaccattacgtattaatttaacaagtaatgagaattttacagataaagattggcaaattacaggtattccgcgtacattacacattgaaaactcgacaaatagaactaataatgctagagaacgtaacattgaacttgttggtaatttattaccaggggattactttggtacgatacgttttggacgtaaagaacaattatttgaaattcgtgttannccacatncaccacaattacaacgacagctgagcaattangaggtcaggaattacaaaagtgcctgttaatatttcgggaataccgttggatccatcggcattggtttatttanttgcaccaactaatcaactacgaatggtggtagtgaggcagatcaaataccatctggttataccat

SEQ ID NO: 156 - DNA (Genomic DNA), 1118 bp; single-stranded, linear
ggcacgagactcaaancactgaagcattaacaaaataatactatattactgtctaatcatagacatgttgtatttaactaacagttcattaaagtagaatttatttcactttcaatgaactgttttttatttacgtttgactaatttacaaccttttcaatagtagttttcatgccacgagctatcctaacccacagattagtgatttctatacaattcctcttttgtctttacattttcttaaaatatttgcgatgttgagtataaatttttgttttcttcctacctttttcgttatgattaaagttataaatattattatgtacaacgattcaatcgctctatttttcaactttcaacatattattaattcggaaaggaccactttaaaatttaacnggccacaacaaatcaaatcaattaatcactttttccaaaataatcatataaggaggttcttttcattatgaatatcattgagcaaaaattttatgacagtaaagcttttttcaatacacaacaaactaaagttattagttttagaaaagatcaattaaagaagttaagcaaagctattaaatcatacgagagcgatattttagaagcactatatacagatttaggaaaaaataaaggcacgaagcttatgctactgaaattggcataactttgaaaagtatcaaaaatgcccgnaaggaacttaaaaactggactaaaacaaaaaatgtagacacacctttatatttatttccaacaaaaagctatatcaaaaaagaaccttatggaacagttttgatcattgcaccatttaactatccttttcaactagtattcgaacctttaatcggtgctattgcagcaggtaatacagcaattattaaaccatctgagttgacaccaaatgttgcacgagtgattaaacgattaatcaatgaaacatttgatgcaaattacattgaagttattgagggaggaattgaagaaacgcaaacgttaattcacttaccttttgactatgtctcttacaggagtgaaattgtaggcaaatcgtttatcaagctgcagcgaaatttagtcctgtgacatagaatggtggggaaatctccagtcatcgnggg

SEQ ID NO: 157 - DNA (Genomic DNA), 675 bp; single-stranded, linear
ccanttgccgtttcctcctaaacaccagcggnacgagctcatgatggcatacattgtaaatccgataattgacagtccagttgctaatccatctaaaccatctgttaaatttaccgcattagaaaaacctacttgccaaaaaacaatgaaaataacatatgcaaatgatagtgggattgctacattcgtaaatggaatatgtatgctcgtagaaaaattcaccaaatgaaacacattacttaaaacaaagaaaataatcgcaataccaatttgcgccaaaaacttctgtttacttgttaaaccttggttattctttttaacaacaataatataatcatctataaaaccaattaacccaaaaccaatcggtcacaaataataacaggtatgattggattagcttgatcttacaaatataatagccaccaaagacggttatcacaaatactttaatagaaatggttaggccacccatcgttggtgtaccagtcttcttcatatggctttgtggaccttcttctcgaatactttgaccaaatttcatcctttttaatgtaggtattaaaacaggtaccaaaacaaatgtaatcactagcgctaataacgcatatacaaaaatcataactatctcctcttcttaatccagacttttttaaccactaatatattatcaag

SEQ ID NO: 158 - DNA (Genomic DNA), 746 bp; single-stranded, linear
cttagatacaattactcaatatgatgtactggaagcanttatagatactaaaaaacacattgnctgtncgatgantntcatcttcacatganntancgggttgattaacnaagattgcagaccgtgntgttgtgatganaaatggtcanctgatagagcatggtacacgtgaatcagtcttgcatcatccagaacatgtttatacgaagtatttattatcancgnagaagaagantaatgatcattttaaacatgtgatgaggggtgatgtacatgantaaagttacagatgttgaaaaatcatatcaaagcncacatgtttttaagcgtcgtcgaacacctatcgtgaaaggtgtgtcatttgagtgtccaatcggtgcgacgattgcgattatcggagaaagtggtagcggtaaatcgacgttgagtcgtatgatattaggtattgagaaaccggataaaggctgtgtaaccttaaatgatctaccgatgcataagaagaaagtcagacgtcatcaaattggtgctgtatttcaagattatacgtcatcattacacccatttcagactgttagagaaatcttatttgaagtgatgtgtcaatgtgatggacaacctaaagaagttatggaagtccaagcaattacattgttggaagaagtcggtctatctaaggcatacatggataaatatcctaatatgttatcaggtggagaagcgcagcgtgttgcgattgcgctcgtgcc

SEQ ID NO: 159 - DNA (Genomic DNA), 692 bp; single-stranded, linear
aatgtcagacagatactgccacaagatgcgtgcntatgagatttcgctgtgtatgaatagcgacacgagcggcacgagcgctcacntcatttccaattaaaactaatgcctaaatctgatgcagtaaaatctatcatgattcactcttaacatccgtatttcgtgctactaattgatgtcttgcattgaaaaattgaccatagcttaaatatgtcgcaatcaaagcagacataatgntcgcagttgtatgaataaacacgactaacaattgaaatttaatcgcttgtaaaggtggtacgccaccaataattaagcctgtcatcataccaggaatcgacacaagcccatatgttttaaccgaatcaattgttggcacctatagctaaacgaatactttcacgtattgcacctttagaagccaatttaggtgtagctgcaagtgataatttagattcaatattagtaccatcttgtacgaatgcacgatctaaattctggtaagctaaattaattgcaatcaagccattatttncaagcatnccgccgataggtataacttcattggctgtaaaatgaattgcccctgtagctacagtacctgcaagtggtaatgctgttccaatgaagatngctggaaatggtntccaaaacacanggggcatcactgtgatgctcgactaatggtaagagtc

SEQ ID NO: 160 - DNA (Genomic DNA), 857 bp; single-stranded, linear
aatatagcgttttnacccctttgtgtnaccctccccaagagatataacatnccgccgtntaaaatcaattagaaatatctttttattctgataatagacacagtatagacacattttaatgggtgataccacttgtaatatcacggggttgtnatgtnttgnatatcantnaaatacttatatanaaatattgctcggaatataaaaagntaaataggnttttgagttttaaatatgaaatacaaagcgcccantcgaacaaagtatttatattaaaatatggaaaatccatcantattaaattaaaatngttttattatgataaagtgaaagtaggtaagtctatggaaggtcttaatcatcgaagaaatacagaaaaagaagagacaacacaaacgcaatcagttgcacctaatacaggtgaagaggggatgtcatcaggcaagtaacacaatcaantaagacgtccgacatacataaatgaatctatcaataaacaaatggaagccaaagcgcatgaaacagcgcaaaatgcagatttaaaaaccgaagcaagaagtttatttgataatgcaaccaaatcaatcgggagactagccggcaatgatgaaagcataaatcttaatttaaaagatatgttttctgaagtatttaagccgcatactaaaaacgaagcagatgaaatatttatagcgggtactgctaaaactacgccagcaatttgtgacatatcagaagaatgggggaagccatggctcttttctcgagtattcatcgctttcacagtaacatttattggattatgggtcatggcagcgatttttaataacaatgacgcttgtaccggtgctcgtgcc

SEQ ID NO: 161 - DNA (Genomic DNA), 907 bp; single-stranded, linear
ctcactttgttttccagtatggaacgcttgccctaagtccttaattgcattataaaattcaggcgctaaaataatcgcaattgccgcagttttaaaatcaatattatgaaatactactaagcttagcgttgcttccaatgcaaccaatccaatacctaacatacttataaattcgagcattaatcccgataaaaaagcactgcgtaaaatgcgcattgttaaagttctaaactgagtactatcgtcgtaaatatgcttctctgtttgctctgtacgattaaatagctttaacgtcactaaacctntagcaatatttaaaaaccgncgactaaattgattcanataagtcatttgatctttttgacgcatcgagcgttttcaaaccgaaaataatataaaacaaaggaataaatggtgcagntattaacataattaatgcggnattgaaatggatgaaaaacaatgcaatgattatgatgagcngaaccatcaatcgatttgaacaacttgaggcaaataactcttataaaaaggtgctaaaccatcaatgttttctgtgagtatagtcatttgttcaccgattggatgaccattatttttataaataacccgctgtctaagcatatgcttaactttaaatgctaatgtatcacctaaccattgatttagaaattgcacagntgctcttaaaagtaaaacacctaataaaataaataatacaatccataaaccttgaaattgatgtcttataattttagctaaaaaatctgctattaaaatattgtgcgttataacgagtatgcccgagaccagtactgaccaagaacatgagtaccggaaaaattttatattgaaacagtattgttgttaatttttcacaattatatcacctaacctatataaagtt

SEQ ID NO: 162 - DNA (Genomic DNA), 774 bp; single-stranded, linear
aattttaaagaccccncgcataaatanccatcccacctacttatccaaaagttangtggatggtttttcaattaaaattaatattagtgtaanccaatcaaagatttaatcnaatatgcccctgctcaaaacatttcctcatttaatttgctttactttcaatttaatatcattatccacaacacttggcgtgtcatcgttattatttcgcatctttgacacgtttatcatcattaggantcggcaccgaataaaattgcgataaatgccatgattcccattaatacgttaacccaaagtgcaatcatcgcacctgtatgaatgctcgttgcagcaactgcaccaacatatacagcaccactaattgcgacaccgaatgcgccaccaagtgatgaagccattttataaatacctgaagcaacgccaactttatctaacggtgcattcgaaatagctgtatctgtagaaggtgttgcataaatacctaagcctagtccgaaacataaatatcctacgacacaactgataacataaaatatgcctggtaagaatactantgaaataagtgcaatnccaatgaccacaatgnatgtacctnataacattggtcgcttagaacccanttntggtnataataatttttcaccaactcgaatcatcaataacaacatgattaaataagtaantgatnagtatcctgcctgccatnctgtataacctaaaccttgttgcacgcatgtattcgctacaattnatgtacctacaacnccgttg

SEQ ID NO: 163 - DNA (Genomic DNA), 773 bp; single-stranded, linear
ctctgattcaacaaaatgattattctttacgtaaactacctttttttatttgagatgaagcatatgcttttaataatattgtcccaataataccaactgaaataatatttaatactgcagagataacaccttgtgtataaaccttgttagccggttcgttataaatcaaaatatctaatgttggtgcaataagtgcccagcaaataatattcgcaataatttgaccgatattaaaataaatcatcgatttcctagaaaataggcatgaagaaagatttaattttagggccaatccatccatattaaacaggcgataattcctgaacaaataacccaactccaccaagcactacccgtatgtcggggaaatctttaatagcgtgnccaactaatccaggcattaaaccagcaaaaggcccaaatattgcagatattaatgctaaaaatgcataagatgtttctatattcgtattaggaaaacctgttggtattacaacaaaacgccctaaaatcacaaataccgcngctcctataccaatcgcaacaacagttttaactgaaatatcntgttttttcatcttcattactccttacataaaaaattcattaaattgatggtgctttagataaatgaatcgtccaatcatttccagtaccaatatgatataaatctgaaaatgagtctcgattgactgctacaccaatatttactagcgagttaacatacacaagaggttcacccacattaacatctgcaaacgatcgctcgtgcc

SEQ ID NO: 164 - DNA (Genomic DNA), 676 bp; single-stranded, linear
cataagacatgtaaattctaagatgatttgttggatagggtagctccatataattcttgaatccnatcattattacattaataaaaaaaacacccacaattgtgggtgattgtaatgaacgtattatcttggcacgagtactcaacgattaattgttcgttaatttcagcaggtaattcgctacgttctggtaaacgtacgaaagtaccagttaagctgtcagcatcaaagtttaagtactcaggtacgaaattgttgatttcaactgattcaacgatgatgtttagtttttgagatttttcacgaactgaaattgtttgaccaggtttaacagaataagatggaatatcaacacgtttaccatctactaagatatgaccgtggttaactaattgacgtgcttgacgacgagtacgagctaaacctaatgaataaacaacagcgtctaaacgacttgctaataaaatcatgaagttttcacccgcgtacacccnaattttttaccagcgatgtcaaatgtgttacggaattgtctttcagtcaatccatattangtaacgtaatttttgtttttcacgtaattgtaaaccatattctgataattttttacgttggtttggaccatgttgtcctggtgcgtaaggacgtttttctaattctttaccagtctcgtgcc

SEQ ID NO: 165 - DNA (Genomic DNA), 397 bp; single-stranded, linear
ggcacgagcgatgatggctgtcggaacaggtgcatttggtgcgcatggtttacaagggaaaaataagtgatcactatttatcagtatgggaaaaagcaacgacgtatcaaatgtaccatggcttagcattattaattataggtgtaattagtggtacaacttcaatcaatgttaactgggctggctggttaatatttgctggtattattttctttagtggatcattatatattttagtattaactcaaattaaagttttaggtgcgattacgccaattggtggcgtattgttcatcattggctggataatgttaatcattgcgacattcaaatttgctggttaaattttaaaactttagattacctatgtaactaaacattaaatttttaanaaaaa

SEQ ID NO: 166 - DNA (Genomic DNA), 739 bp; single-stranded, linear
tatctttaagaacaattgaagccgctaaccatcggagaaagctgtaaaatccaagtgttggcctgctaaatacccacaatcatcacgggtcgttgccttgtaccacaatagaaggcagcattatcacccaaatatttgcatagctaattgtgataaaactgtcgtttccgtttgtggcataattccataaacatatgctaaaccaccgataccaactaataaaaacgctaaaattgaacccatagcaattaacgtttttacagcattattagcacttggttctctaaaaattggtgaccgcatttgaaatagcttcaacacctgttaatgatgaagcccctgatgaaaaagctcttaatagcaagaataatgttactccagganccgcagttcctactgatgcatgcatatgtggttgaatatctcctgtcgccacacggaaagtaccctataaatattaatatcactaaccccataatganaagatatactggataggataatacggtgncagattcagttaaacccacgtaaatttaatattaaaataaaaagtacaagtaaacatgcaatcagtactttatgcccatataaacttgggaatgcagcaacanatgcatcagcaccagatgatatactaacagcgacagtcagtatgtaatcgactaataatgagcctcctgcaagcaatccccatttttctcctaaattggtcttggacaccatatacgctcgtgcc

SEQ ID NO: 167 - DNA (Genomic DNA), 507 bp; single-stranded, linear
ggcacgagcgagaacgattgaagctacaatacctgatgttgctgcgggaagtacgactttagttgctacttctaatttagttgctccaagtccataggcaccttctcgaattttatttggtacagatgccattgcatcctcactcaaacttgtgatgagagggacaatcataataccgacaactaagccgggacttatagcattaaactctccaagacctgatatgaaagatcttaatactggtgtaacaaaggttaatgcaaagaaaccaaacacaattgttggtattcctgctaaaatttctaatatcggtttaattatgcgtcgggcacgggcacttgcatattcacttaaataaattgctgcaccaagcccgactggaactgcaaatatagtcgcaataactgtgatttttaaagtccctattatcaatgccagataccaaacttagggtctgaaccggtaggattccagtagtagaaatagaaatcagtattggaattctgg

SEQ ID NO: 168 - DNA (Genomic DNA), 753 bp; single-stranded, linear
gaatagtctactcattcatcgtccttcaccattgatggatccagaacaagttgctgatgcattaactaaacttgttaaacaaggtaagttgaagtcattcggggtgtcgaattttaatcattcacaataccaattgttaaatcaatatattatgaaagaaagactacatattagcatcaatcaattagaattatcgccatatcacgttgatagtttacaagatggaacaatggattcaatgtatcaaaaccatgttcaaattatggcttggagtccttttgcaggcggtaaaattttcgacaaggaagatattaaagcgcaacgtattatgaaagttgtcaatcaatagctgacaaatatggtgtgagtgacacagctgtgatgatagcatggttagtaaaaataccgcatagtaccatgccgatactgggaacaagtcagttaaagcgtatngatcaagcaatcgaagggctacaacttaatttagatgatcaagtcgtgggttgacatttacaacgctattatcggacaagatatcccgtaaacttannnacncnnaaatcataaatggagcataccatgacaaacgaagataaacgtttcgaacaattaagatttgaacgcaaatttatagttatcccgtatttaatttatgcagtcattgtattactattaaatattttctattctgatttgaaaataacaatgacattattcggacttttctttgcgtataatgtagtcattttgttc

SEQ ID NO: 169 - DNA (Genomic DNA), 542 bp; single-stranded, linear
cccattattatttngaaaatgaattggaaaatacagtagacgaagtgtgggttgtatacacttctgaaagtatacaaatggatcgtttaatgcaacgtaataatctgncattagaagatgcgaaagcacgtgtctacatacatcaacgcgtacgtaaagtaatgacttatttatagtgtaatattaatcttcttctccgnaattcggntttncaatataaccttcttcttctaacaanctctcaaggttgtgngtnaatncaagtttatcccctaaattatcgataacatgatcggccantcggntnnnnnnatcaatagaaatttggnttatagacacgtgctttcgcatcttctaatgacagatcatnacgtngcattaaacgatccatttgtatactttcagaagtgtatacaacccacacttcgtctactgtattttccaattcattttcaaataataatggaatatccacgaaccacattatatccttggttttaaatattcttgcttttcttctgccataatatctcgcacgaata

SEQ ID NO: 170 - DNA (Genomic DNA), 731 bp; single-stranded, linear
tcaatccancctccaattgctgatgaagaacctccttcagcncccacccattannggggccanagtcataagtaacaacttttgaaccaattgtatcttcaattgaatctgtaatcttatctcccgcttcttcccatcctaaatgttctaacattaatacagaacttaaaattactgaagntggattcactttatttaaacctgcatattttgganctgagaccatgtgttgcttcaaaaatagcatgacctgtttcataattaatgtttgcacctggcgcaataccaatnccaccaacttgtgcagctaaagcatctgaaatatagtcaccattcaagttcatagttgctacaacatcatgctcagctggacgagttaaaatttgttgtaagaaaatgtcagcaatagaatctttaatgataatcttgccttctttcacagctttttcttgagcagcattagcagcatctctgccttcatttacaacaatttcgacatattgttgccaagtgaatacttgcatcaccaaattcagataatgctaaatcgtaaccccactgcttaaatgagccttctgtaaatttcataatattacctttatgaacttaaagtaacttgatttacgggttatttatcgatagcatattggtatagctgctctactaatcgctcaagtccttcttttagaacttggtttaataccaatacctgaaggttcttggaatcgatt

SEQ ID NO: 171 - DNA (Genomic DNA), 695 bp; single-stranded, linear
tttgacatctctcaaaaattaaagcataaaggtttatcggaaaggcgcaaaattcacagttgtttgttggtttgttatttccctcncaatattcagtattagacatttatagtttggaaaatgcgtgataattagttgtattcagttattaagtaataaatttttggaggcagaacatcatgaaattaacattaatgaaattttttgtggggggatttgcagtattattaagttatattgtatctgataacaataaccttgggaaagaatttggcggtatatttgcaacgtttccgggcagtatttttagtgtctatgtttattacaggtatgcaatatggtgataaagtcgctgtgcatgtaagtcgtggcgcagtgtttggtatgacaggggtattagttgtattttagtaacatggatgatgttacatatgacgcacatgtggttgattagcattattgttggtttcctaagctggttcatcagtgcagtatgtatttttgaagcggtagaatttatagcacaaaaaagattagaaaagcatagttggaaagctggaaaatcgaatagtaaatagtgtgaacgtaatctcttaactaggactaactttgcaagcattgaatagcatggaaaagttgcatcattaataagtgaaattcaagttggcattgagaaaattacaagcgctcgtgcc

SEQ ID NO: 172 - DNA (Genomic DNA), 612 bp; single-stranded, linear
ggcacgagctcggcttgacggtaggaaatatcagcacgagcttgattcaacanccgaatcagggaggaaatgcaggtataactcaatctaagttcgctaagagacatccaacgttttacnaggcaaatccaagcnaaaaggattgcttcnaataatatcccaccaaacaatttaagacattatgctgttaagaggtcaccaacnatatatatagtggttacggatcagttattagcgttctttaacaacagatattggcgctcacagtttaacccaagaggtggttggtctccaagtggtccaagaagatatgcgaatggtggtttgattacaaagcatcaacttnctgaagtgggtgaaggagataaacaggagatggttatccctttaactagacgtaaacgagcaattcaattaactgaacaggttatgcgcatcatcggtatggatggcaanccaaataacatcactgtaaataatgatacttctacagttgaaaaattgtttgaaacaaattgttatgttaagtgataaaggaaataaattaaccgatgcgttgatcaaactgttcttctcaggataatacttagttctatgatgcacttagaagtt

SEQ ID NO: 173 - DNA (Genomic DNA), 605 bp; single-stranded, linear
ggcacgagcgactttttctaggcataatcgaattgacaatggtactcaagcttaaaaatggcccacttaattcaggcaataacagactaggcataacattatttttcatcaatttaaatgtgtaaaacatcgatgacattgtctgttgctgttgtcgataaacattcatatcgtagcggtctgcaaattctttaatgcgatatgccggcggcacgagacatgacaggtaatgaatcatgtttgaattgttcgtctacggcatctttttgaataggtaatccaaagaaacctgcaataccaatcgtttcaaagggccctgctgcttcgatatgtctacgaaatggttctgaacgaacatctatacaaaatgcaatttgcgctttcgttgatgtgcccacctgatttagctcgctattattttcatcaactgcttgtgtgtcaattaacaatactgaatgtggctgattagcgttatcattttctgagacatttacttggtttacatctaatgcgcccgccacactttcatgactgctttaatttttgttttaactgagatcgtatgtcaatttcccaggcaattagccataaatttntaaatacat

SEQ ID NO: 174 - DNA (Genomic DNA), 508 bp; single-stranded, linear
ggcacgagctgatcaagggtgtaagttggtagtggtcaataaagaacaatcattaccagctaacgtaacacaagtggttgtgccggacacattaaggagtagctagtatttctagcaacaacaacattatatggattatccggagtcatcagttagtgacatttggtgtaacgggtacaaatggtaaaacttctattgcgacggatgattcatttaattcaangaaagttacaaaaaaatagtgcatatttaggaactaatggtttccaaattaatgaaacaaagacaaaaggtgcaaatacgacaccagaaaacagtttctttaactaagaaaattaaagaagcagttgatgcaggcgctgaatctatgacattagaagtatcaagccatggcttagtattaggacgactgcgaggcgttgaatttgacgttgcaatattttcaaatttaacacaagaccatttagattttcatggcacaatggaagcatacggacacgctcgtgcc

SEQ ID NO: 175 - DNA (Genomic DNA), 750 bp; single-stranded, linear
ggcncgagactgtcgaatatttagtagtaacttcagattacaagcgtatgacttatcgaccgaacggtacaaataaagtatttgttaaaagaaaagaagcgggntcatggtctgagtggtcagaattagctattaatgattacaatacaccttgtgaaactgntcaaagtgcccantcaaaagctaatatggccgaaagtaacgctaaattatacgcagatgacaagtttaataaaaggcattcgagttatttgtggatggaacagcaaatggtgtgggctctacattgnacttaaatgagagtttagaccaatttattttattaattttttatgggacttttccaggtggtgactttacagagtttggcagtccttttggaggaggaaagatttcattgaatccctcaaatcttccagatggtgatggaaatggtggaggtgtttatgagtttggattaactaaatctagtcgtacatctttaactatatcaaacgatgtctatttcgacttaggaagtcaaagaggctctggtgcgaacgcaaatagagggacaattaacaaaattataggagtgagaaaataatgcaaatattagttaacaagcgtaatgagataatttcatacgctatcattggtggctttgaagaagtatgatattgaaattacagaaattctctcaagttttagactaagctttaaatatcaatgggaatagttttacgaagatatccgagaaaagatgactgc

SEQ ID NO: 176 - DNA (Genomic DNA), 787 bp; single-stranded, linear
aaatgccgggggagctcaagtatatgactgaaataacattcaaaggtggaccaatccactaaaaaggtcaacaaattaatgaaggtgattttgcacctgattttacagtgttagataatgacttaaatcaagtaacattagcagattatgctggtaaaaagaaattaattagtgtggtaccatcaattgatacaggtgtttgtgatcagcagactcgcaaattcaactctgaagcttctaaagaagaggggattgtgcttacaatttcagcagacttaccattcgcacaaaaaagatggtgcgcttcagcaggtttagacaatgtcattacattaagtgaccaccgtgacttatcatttggtgaaaactatggcgttgttatggaacgaacttcgtgccgaattcggcacgagctcgtgcagtatttgtattagatgtagataataaagttgtttataaagaaatcgttagtgaaggtactcgatgccccagattttgatgctgctttagctgcatacaaaaatatttaatcattaaagagataaatcttaaaatgtatacatcgtgtccatcgttgtcaacagcattaaaatagaattgttttctatgattgctaagacctatgggcactttttattggagagggacgaatatggcagaacaacaaacaattatggaacgcttgtttcatacattagatgaaaaagctaaaacattaaataatgaaaatggccaaagttttattgaaaatcttgggctagcaatggaacaagtatataccaatgaa

SEQ ID NO: 177 - DNA (Genomic DNA), 568 bp; single-stranded, linear
ggcacgagcgcgtcatataatgaaagtaatgataaaaagaaaggataacttaatgtgagtcaagaacgttattcaaggcaaattttatttaaacaaataggtgaaataggtcaaagcaaaataaatcaaaaatgtgcgttgattattggtatgggcgcattaggtacacatgtggccgaaggacttgttagagcaggcattgctaaactaatcattgttgatagagattatattgaatttagtaatttacaaagacaaacattgtttactgaagaagatgctttgaaaatgatgcctaaagtggttgcagctaaaaagcatttgctagcgttacgtagtgatgttgatattgatggttgtattgcccatgtggattattattttttgggaaacacatggacaggacgttggacgttattattgatgcaaccgataactttgaaacacgacaactgattaatgattttgcatataaacatcgtattacctggatttatggcgggcgttggtcagagtacatattcaggaagctgcatttatacctggnaaacacctgctttactgttgg

SEQ ID NO: 178 - DNA (Genomic DNA), 573 bp; single-stranded, linear
ctacnntaataagaaaatataacatacnaatcaaaaactaaagggatgtgacgttaatgaaactcgtatttgtggcacgagctggtaatatggcacaagctatatttacaggaattattaactcaagcaacttagatgccaatgatatatatttaacaaataaatctaatgaacaagctttaaaagcattcgctgaaaaactaggtgttaactatagttatgatgatgcgacattattaaaagatgcagattatgtttttttaggtaccaaaccgcatgactttgatgctctagcaacacgcatcaaaccacatatcacaaaagacanttgcttcatgtcaattatggcaggtattccgactgattatattaancaacaattagaatgccaaaatccagntgctagaattatgccanacacaantgcgcangttggacactcagttactggcattagtttttcaaacaactttgaaccctaaatcctaaagattaaattaacgatttagttaaagcatttggtctgtattgaagtatccagagatcattttacatccagttacagctatcacc

SEQ ID NO: 179 - DNA (Genomic DNA), 619 bp; single-stranded, linear
ctctattataaacatattaaaacgcatttttcatgcctaatttatctaaatatgcattttgtaatttttgaatatcacctgcacccataaataaaacaacagcattatcaaattgttctaatacattaataagaatcttcattaatgaacgatgcacctccaattttatcaattaaatcttgtatcgttaatgcgccagaattttctctaattgagccaaaaatttcacataagaatacacgatctgctttacataaactttctgcaaattcatttaaaaatgcttgtgttctagagaaagtgtgtggttgaaatactgcaacaacttctttatgtggatatttctttcgtgctgtgtcaattgtagcactaatttctcttggatggtgtgcataatcatctacaataacttgatttgcaattgtagtttcattgaaacgacgtttaacaccaccaaacgtttctaatgcttctttaatatttgtaacatctagcttctctaaataactaatcgcaattacagctaatgcatttaaaactgtatggtcaccatattgtggagacaggaagtgatcataaaactcaccatccacatacacatcaaaagcagtctcgtgcc

SEQ ID NO: 180 - DNA (Genomic DNA), 443 bp; single-stranded, linear
ggcacgagcgtgtcaatatttacatgatgatttcatttaatagccttttttagcatcaacttcattctcaattagaccattcttattgagaaaattaactagattgtttttaaaaatatctaataagtcatactttgcctcataatcattaccagttatatgcgctgttatagttacattttccaattcatataattcatgattaggtttcaaaggttcattttcaaacacatctaaatatgcatgtcgaataactttactttttaatacttctattaagagcgcttcctttaactatgctacctcgtcctatatttataaaaagtgcttccatcctttcattaattccaaaatgtttttttcctttagttaaatgaatccgtttccttgcgtttcctggtaaagcatttataataatgtcagcatttggtaatgtgctttca

SEQ ID NO: 181 - DNA (Genomic DNA), 569 bp; single-stranded, linear
ggcacgagctatgtggtttgaagtcaatcgccaaatgttccacctaccattctgataaaagtatttacttgttctttattccataacacatatactttatgatctctattttcaaattgtctatgcacatatttttgtaaaggatgcaactttcctttttcttgcttcatttctacaaaatatgtttttccttctggcataataataattctatctggcacacctcttgttccaggtgcgacccattttaaacataaaccgtttagctttgttatctctttcactaaatatttttctaatgtcgattcctttcatttattcaccttgtatacaaaatttatatttgtgttccgaatgtttgttatcaattccttgccaaactttttaaaaatagctgtttagagggtttacccctataccccctttactcccctaaacactacttttttaaactttatagtgaatttgaatgcaacattgggaaacaaacaggtttgaacccctacagctagaaagaagagtgtttgtaatcattgttgcatcatgttgcatcaccaaaatgatacaac

SEQ ID NO: 182 - DNA (Genomic DNA), 511 bp; single-stranded, linear
ggcacgagcgcaaaatatttcaaataaaaatgattgtaaaaaggcaaaatacaaaatttcacttaacaactagtacataaagtaatacaattaaattaattctatctgaaagatgtgtggggcatcgttattttaggtggatatgagcaatttattaaaagtcatttacggaaaatatatatagacggggtgagtaatatgcaagaacatgtggtggttacacttgatggaaaagattatcttgtagaaccaggtacgaatttacttgaatttattaaatcacaagatacttttgtcccttcaatttgttataacgagtcgatgggcccaattcaaacatgtgatacatgtactgttgagattgacggtaaaattgaacgctcatgtagtacggtgattgatcgcccaatgactgtaaatactgtgaacaatgatgtgaaagatgctcaaaaagagccttgatccgaattttagaaaagcatatgctgtattggacagtatgtgattatta

SEQ ID NO: 183 - DNA (Genomic DNA), 1125 bp; single-stranded, linear
atcctttatttntaaggcgtttcatcaagctaacacttcattatctttagtcgctttaatgcccttctattaaactcggaactaaaaatggattgncttttcaaccacccgancactaaaacattgtcntttttgatggccnattaagacacaatttcccgctgtttgcttcaaagtagcttgcttcttgnattnattttcaatatctttcttgttaaaaacaagantgttgcacagtttgattggcatctttatttagancaatggcatctgcttgccacttatcaatgccttctttattcatattgataagaccattcgccaatccagataataaaaatagcaagtaactaatcatcgttaacacaccaataattagtccaaacttcaatttgttgcgccgtatttcattccaagctaaaaacatgcatttctctccctactactatgatttaaacattgtttatattcttagatgcacgtacgtcgtgttgcgctctgtaatgttatacatacacttatccttcattatacccganctttttatattaaaaccaaatttatggaaaatgcaannanttgtctattatttttgtgcggtacatttaaaattaaggatcaatttaaaaacgcctacatatacctttaagtacatgaagacgtccaattcatatattatttaacttcgcctgttttaggatcggattgcttaatagcatttttacgtaatttatcttttgctttgtcacttgctttatagttattgttgtaaatcgtagcttcccaactaccatacattgggttagggaaaatgatatatttcttaccgaaatcgtctttatgtttttcaattaatgcttcacgagattcagctgtagcttcttttggatctgtaaagtctaataaattatctccaaatagcatgacaagtttatgatccttttgaaccatttgtctgcgtgattctttactcttatcatctttaccttttagtaaaatatgactcttcttagcttgagggataccttgttgttttaagttcttttgtgttgcctttaaatctttttctttatctctatcagaaatatagtagatatcgacaccttttttgtcagcatatttcaa

SEQ ID NO: 184 - DNA (Genomic DNA), 3100 bp; single-stranded, linear
agaagcatataaacaaaacatgttcgcattattaggtaaaactggttttgaagacttgaaaaaagaattagaagagcgtttataaaatacattacttcaatgattagtgaagtttgaaaagatagaactagacgttaactatttaaagcatattttcgaggttgtcattacaaatgtaaaaatgtaatgacaacctcgtttttatttatatgcaagaactaggttactagctaatgtgacaagatgttaagagaaaattaaagaaaaaataacatctgtcatacaataatattgttatactactagagactgatttattagcatgattacatgttaatgtttctttacttagtaattaactttataatgtaagaataattatcttcaaccaaagaaagggattgatgatttgtcgtttcatcaagtagaagaatggtttgagatatttcgacagtttggttatttacctggatttatattgttatatattagagcgataattccagtatttcctttagcactctatattttaattaacattcaagcttatggacctattttaggtatattgattagttggcttggattaatttctggaacatttacagtctatttgatcttgtaaacgattggtgaacactgagaggatgcagcgaattaaacaacgtactgctgttcaaacgcttgattagttttattgatcgccaaggattaatcccattgtttattttacttgggntttccttttacgccaaatacattaataaattttgtagcgagtctatctcatattagacctaaatattatttcattgttttggcatcatcaaagttagtttcaacaattattttaggttatttaggtaaggaaattactacaattttaacgcatcctttaagagggatattaatgttagttgtgttggttgtattttggattgttggaaaaaagttagaacagcattttatgggatcgaaaaaggagtgacatcgtgaaaaaagttgtaaaatatttgatttcattgatacttgctattatcattgtactgttcgtacaaacttttgtaatagttggtcatgtcattccgaataatgatatgtcgccaacccttaacaaaggggatcgtgttattgtaaataaaattaaagttacatttaatcaattgaataatggtgatatcattacatataggcgtggtaacgagatatatactagtcgaattattgccaaacctggtcaatcaatggcgtttcgtcagggacaattataccgtgatgaccgaccggttgacgcatcttatgccaagaacagaaaaattaaagattttagtttgcgcaattttaaagaattagatggagatattataccgcctaacaattttgttgtgctaaatgatcatgataacaatcagcatgattctagacaatttggtttaattgataaaaaggatattattggtaatataagtttgagatattatcctttttcaaaatggacgattcagttcaaatcttaaaaagaggtgtcaaaattgaaaaaagaattattggaatggattatttcaattgcagtcgcttttgtcattttatttatagtaggtaaatttattgttacaccatatacaattaaaggtgaatcaatggatccaactttgaaagatggcgagcgagtagctgtaaacattattggatataaaacaggtggtttggaaaaaggtaatgtagttgtcttccatgcaaacaaaaatgatgactatgttaaacgtgtcatcggtgttcctggtgataaagtagaatataaaaatgatacattatatgtcaatggtaaaaaacaagatgaaccatatttaaactataatttaaaacataaacaaggtgattacattactgggactttccaagttaaagatttacccgaatgcgaatcccaaatcaaatgtcaatccaaaagggtaaatatttagctcttggaggataatcgtgaagtaagtaaagatagccgtgcgtttggcctcattgatgaagaccaaattgttggtaaagtttcatttagattctggccatttagtgaatttaaacataatttcaatcctgaaaatactaaaaattaatatgaaacaaatacaacatcgtttgtcggttttaatactgataaacgatgttttatttggttagtaccacaataaaagctaagttcgaaatgaacttataataaatcaatcacaatcactttgtgttaaaatatgtgtcaaaggaagtgagggtttgtcatgacattacatgcttatttaggtagagcgggaacaggtaagtctacgaaaatgttgaccgaaataaaacaaaaaatgaaagcagatccgcttggagatccaatcattttaattgcgccaactcaaagtacatttcaattagaacaagcctttgtcaatgatccggaattaaatggtagtttaagaacagaagtgttgcattttgaacgattaagtcatcgtattttccaagaagttggtagttatagcgaacaaaagttatctaaagctgcaacggaaatgatgatttataacattgttcaagaacaacaaaagtatttaaaactttatcaatcacaagcaaaatattatgggtttagtgaaaaattaacagaacaaattcaagattttaaaaaatatgcagtaacgcctgaacatttagaacactttattgctgataaaaatatgcaaactcgaactaaaaataagttagaggatattgctttaatataccgtgagttcgaacaacgcatnccanaacgagtttattactgntgaggattcatnacaatattttattgattgtatgccgaaatcagagtggctaaaacgtgctgatagatatattgatggttttcacaacttttcaacgattgagtatttaataatcaaaggattaattaaatatgcgaagagtgtcacaattatattgacgacagatggtaaccacgatcaatttagtttatttagaaaaccatcggaagtgttacgacatattgaagaaatagcaaatgaactcaatatttctattgaacgtcaatatttcaaccaattatatcgcttcaataatc

SEQ ID NO: 185 - DNA (Genomic DNA), 817 bp; single-stranded, linear
ggtggcgagaaaataccgcaaggtcataaagatatctttgatccaaacttaccaacagatcaaacggaaaaagtaccaggtaaaccaggaatcaagaatccagacacaggaaaagtgatcgaagagccagtggatgatgtgattaaacacggaccaaaaacgggtacaccagaaacaaaaacagtagagataccgtntgaaacaaaacgtgagtttaatccaaaattacaacctggtgaagagcgagtgaaacaagaaggacaaccaggaagtaagacaatcacaacaccaatcacagtgaacccattaacaggtgaaaaagttggcgagggtcacccaacagaagagatcacaaaacanccagtagataagattgtagagttcgggtggagagaaaccaaaaggtcccaaanggacctgaaaacccagagaagccgagcagaccaactcatccangtgggccagtaaatcctaacaatccaggattatcganagacagagcaaaaccaaatggcccaggtccattcaattggataaaaatgataaaggttaaaaaatctaaaattgctaaagaatcagtagctaatcaagagaaaaaacgagcagaattaccaaaaacaggtttagaaagcacgcaaaaaggtttgatctttagtagtataattggaattgctggattaatgttattggctcgtagaagaaagaattaaaataattcataatttaaataatagttgatttgcattcactatatttagtttgttaaaaacaacctagaatatgatgagaatgatatacaaccccaaaagttggcttg

SEQ ID NO: 186 - DNA (Genomic DNA), 1348 bp; single-stranded, linear
ccatcgactaagcaatggtatttgttcattaaatcctcatgttgatcgtttaacgttaagctgtcgcatggaaatcgatgctagtggtcgcgttgttaaacatgaaatttntgatagtgttatacattctgattatcgaatgacgtatgatgcggtaaatcagattattactgaaaaggatcctaacattcgcgaacaatataaagaaattacgcctatgttagatttagcacaagatttatctaatcgnttgattcaaatgagaaaacgacgtggggtgaaatcgattttggatattagngaagcaaaagtattagttaacgaagtcgggtataccaacagatgttcaattaagacaacgtggcgagggtgaacgtctaattgaatcatttatgttaattgcaaatgaaacagttgctgaacattttagtaagttaaatgtaccttttatttaccgagtgcatgagcaacctaaatcagatcgcttaagacaattctttgattttattacaaactttggcatcatgattaagggcactggcgaagatattcatccaacaacacttcaaaaggttcaagaagaagtagaaggtcgacctgaacaaatggtcatttcaacaatgatgttacgttcaatgcaacaagcgcattatgatgatgtgaacttgggacattgtggcttatcagctgaatattatacgcatttnacatcaccaattagacgttatcctgatttaacagntcatcgtttaatccgtaagtatttaattgagaaatcaatggataacaaagaagtgaagcgttgggaagacaaattgcctgagttagctgaacatacttctaaacgtgaacgtcgtgctattgaggcagaacgtgatactgatgaattgaaaaaagcagaatatatgattcaacatattggtgatgaatttgaaggtattgtcagctcagtagctaacttcggtatnttcattgaattgncaaatacgatagaaggtatggntcatattgcgaatatgactgatgattattaccgcgttgaagagcgtcaaatggcattaattgggtgagcgtcaagctaaagtatttagaattggtgacacagttaaggttaaagtgacgcatgttgatgtagatgaacgattaattgattttcaaattgttggaatgcctttacctaaaaatgaccgctcacagcgaccagcaagaggtaaaacgattcaagctaaaacgcgtggcaaatctttagataaatcgaaatctgatgataagggtcggtaagaaaaaaggtaagcaacgtaaggtaaaaaccaacgtaataatgataatcaggtaatagtaagcatag

SEQ ID NO: 187 - DNA (Genomic DNA), 982 bp; single-stranded, linear
atgaaaattattttaattttagcattagcgcgtgtcgtttctagacataatcaattcacattcaataaatcattccaaagtgatttgttattatttttcaaaattattggtgtctcgttagtaccaagtattttaatattactgcaaaatgacctaggaactacattagtattagctgctattattgcaggtgtgatgttagtaagtggtataacatggcgtatcttagcacctatctttattacaggtattgttggtgcaatgacagtcattttaggtattctatatgcacccgcattaattgaaaatttattaggtgtccaactgtatcaaatgggacgaatcaattcaaggcttgacccctatacatatagtagggggggggatggctatcaattaactgaatcacttaaagctatcgggctctggacaaggtactaggtaaaggatacaatcacgggggaggtttatattccctgaaaatcatactgacttttatctttncaagngaatgggagaggaacttggctttatcggttctggcaaattgagncttaatatttttatttttaatcttccatctaataagattagctgcgaaaattggagatcaatttaccaaaatctttatcgttggtttcgtcactttacttgtgttccatattttacaaaatattggtatgacaattcagttgttaccaatcactggtattccattaccatttattagttatggtggtagtgcgctatggagtatgatgactggaataggtatagtcttatcaatttattatcatgaaccaaaacgatatgtcgatttataccatccaaaaagtaattaatttaaactattttgagtttcaaatatcataacttttcaagatgacgttatatagtctatttacgtcgtcgatttaaaatgtcatatatagatattactcgataataacaatccctctttgaagtacacattgtaaaatgg

SEQ ID NO: 188 - DNA (Genomic DNA), 1709 bp; single-stranded, linear
ggcactaacttcatttgagcatcctcctatcaattgctatataaattagtacccttttgccacttaattataacaaattctcaaattttaaaaattgaaaatctagttaatgtattagctcgattttgaaatctaataataattggcataaaatggaagtaatattatgtgaggagtgttatgaaatgacaaaaatatcaaaaataatagacgaactgaacaatcaacaagctgatgcagcatggattacaacaccgttgaatgtatattattttactggataccgtagcgaacccatgaaagattatttgcattattgattaagaaagatggtaaacaaggtactattttgtccaaanattggaagtcggaagaaatcaaagcatcacccttcacaggttgaaatcgttggatatttaagacacttgaaatcctttttcactttatccacaacncaatcaataaattacctaattgtaagcggagcaccttaacaagtagcaccgccacaaacaattaatctctgtttcnatgtcaattcattcggagatgttgagttaacaatcacacaattaagagatattaaatccgaagatgaaattagcacaatacgtaaagctgctgagttagcagataagtgtatcgaaataggtgtttcttatttaaaagaaggtgtgactgnacgtgaagtagtcaaccatattgagcaaactatcanacaatatggcgtcaatgaaatgagttttgatacgatggttttatttggagatcatnccgcatcacctcatggcacaccaggagatcgcagattaaaaagcaatgaatatgtactatttgatttaggtgtaatttatgagcattattgtagcgatatgacacgtaccattaaattttggtgaacctagcaaagaagcacnagaaatttataatattgtattagaagcagaaacatctgcaatccaagcaattaaacctggaatacctttaaaagatatcgatcatatcgctagaaatattatttcagannaaggttatggtgaatatttccctcatcgcttaggtcatggtttaggattacaagaacatgaatatcaagatgtttcaagtactaattctaatttgttagaagctggcatggttattacaatcgaaccaggtatttatgtaccaggtgttgcaggtgtaagaattgaagatgacatacttgtcactaatgaaggatatgaagtattaacacattacgaaaaataaggagtgggataaaaatgaaaagcttgttacaagcacattctcattcagtcaaacactgccaatataacattgtagcgcctaagacataaatttttatccaagtctaaatgcaatatgtaacaaacaagctagaaacacatatgcaggtatgttcatcagtaacatgtaatgaatcaaatcaatatcattcatgttcgatgatttcttcgcattgtttctagctttaatttatcattatttaattttaataaccaaggagatgataacgtcagtctttagtacgctgtaatccattcccttttcatcaaattcaaattataattgtaatgcttcttctacagatttatattccatttcaaatgcctctgcaacgcctttattggttacgtgacctttgtaagtatttaaacctaatgataatggttgatttgatttaaatgcttctctataccctttag

SEQ ID NO: 189 - DNA (Genomic DNA), 1355 bp; single-stranded, linear
aaagaggaagatgtgaaccaccactagtattgaatctaaagattgaggacgttcctttattaattggctannnaagnnanatcnnnaagatagccaatccaaagccaaaaagtcagcatcaagaaatacttctannaaggtagcagctnnnnagaagngnnagaaatctaaganaaatnnnaaataatttgtttctttgctaaatagaggagcaccgattgacatcacatcagtcggtgctccttttatttattctttttaattaatttatacaaanccnattccctgttgagcgtgttgaatcgccttccnttgttttgttctcncggtancccatttaaccaaatnataaaccnanatctttntccaaatatttctatttgatcaaaataaggtttgaaatttgcgtttttcacataaccagctcgtgccaatgctatcgtgcaattagctttgagtctgtatataatagtgcgttttgaacatttaattcacgtgcatgttctagtgcataaatacatgcagcccattctgcagtgtggttatccatttcgcctaactcatgtgtatatgtatnatgctgcttatcttctttgattacaatggcacangtacttatgcctggatttcctnttcgtcgcagcatcaaaatttatgtgcgccataataaacctactttctattcaatacttagttaaagttactattactgtaatacaaaatatgttgggtaatccattaaaaaacacgcatcacttaaataagtaaacacgttgttaaaaatacttcgcttgattcaaaagatgattttctaaatacgtagtncttgtaaaatacttcctaaanaaatcatcttcaggctggggacataaatcaatgttctatgctcctnccgaagttatattggcagtagttgactgancgaaaatgcgcttgtaacaagcttttttcaattctagtcaggggccccaacacagaagctgncgaaaagtcagctgacaataatgtgcaagttggggatggaccccancaaagagaaattgtattcccaaattctacagacnatncaagttggggtgggncgacgaaataaattttgcgaaaatatcatttctgtcccactcccttaaaacttattcttttgtgtagtaagtgcgttaatagccttgatctaacttatcaatcttacctttacgataaaatgatttagcaatatatccanntggtacattgaaaactgttgaagctaattttaatacgtaagttgtaataaatatttcnaatncaactgtaccaggtaaacttccgataaaagcgatagctacaaataaagctgtatccaattattgagcttg

SEQ ID NO: 190 - DNA (Genomic DNA), 1410 bp; single-stranded, linear
ccaattttcccttctacctgcgtgggtagtattcaagcccaaagttcagcgggaaaatattgacaattaaccggatccagctaatcggaggtcggataaagatgttgagttgtaagttatttggaatattattttaatagtgtcatccccctttgtaaaataattgtcttacttttaaattaaaagccaaattaatataagaaanctaagacttagtacngtatcaattttgtgcgtttcaattgagttctagttttttttaatatgttaatattaaacttataactttatgggagtgggacaagaatgataaagagccactaaatgatttattatgtagtggttcttaatacattagccacanctaatgtgtacttaaaaataggaatacatgagtaaaactcatgcataagaaatactaatttctatagaaaaagtattactttatcgttgtaccacaccaacttgcacattatcgtaagctgacttatcgtaagcttctgtgttggggcccacaccccaactcgcattgcctgtagaatttcttttcgaaattctctttgttggggcccacaccccaacttgcattgtctgaagaaattggaaatccaatttnctctgtgttggggcccacaccccaactcgcattgcctggaagctgaatttcttttcgaaattcagcttctgtgttggggcccacaccccaacttgcattgcctgtagaaattcttttcgaaatccaatttctctgtgttggggcccctgactaggattgaaaaaagcttgttacaagcgcattttcgttcagtcaactactgccaatataacttcgtagagcatagaacattgatttatgtcccagcctgatatcaccattaaatacaattcatttagtnttcaattggaaacaattnatcgatatattgaatctcatcatctgataaaacgatatctgcagctttaatattttcaatgacttgttctgcacgttttgcaccaggaataatcacatcgatagctggtctcgttaaataaaatgctaatacaatgttcgcaattgaagtttgatgtgctgcagntagnctttcccaaagcttttacgctcgtgacgcacattctcttcaaaaacaccaggtataaaatcccgacgtgtagtacgatggtcactaaatttagtgttctcatcatattttccagctaaaataccggatgctaatgggaaataaggaataaatgtgattaggtgatcaacacaatattgcaatactgcctcattttcgcggtgcaataaattatattctaactgtacaacatcaacgtaaccatctttatttgcttctttaagttgatctaatgtgaaatttgatacaccaatggctttaatcttcccttgttccttaagctcgtgcc

SEQ ID NO: 191 - DNA (Genomic DNA), 2437 bp; single-stranded, linear
gtgttacggtaggttgttgatcctaattttccctgncagttggtcccagtacccacccatttcccaacttactaaaaaagaaatccaattannccgaaagaaaatattgaagtcattgaaattaaccgaagcgttccagtgcacaggtagttgcctccccaaccaagctttaaatatttccaaatacgcaattaaatatatggggtggtgcattagcatcaggtcatccatacggtgcaagcggtgcccaattagtgactcgattattttatatgtttgacaaagagactatgattgcatctatggggatagggggaggtctaggaaatgcagcattatttactcgattctaaccagcgattaaatgtgtcattttctaaggatagtgtggctgcatattatcagtgttttanccaaccttatagaaaagaagtctcgtgcccattaatgtgtncgtcattatggccacaatttgatttatttaaaaaaatatccaaatagcgagctgattttaccacaaatcagcaattaatcaaactcncaagatagaagtagacacaatatatgtagggcatttagaagatattgaatgccgacagactcgcaatatcacacgttatacaatggctttaacattaactaaaaatgatcaacatgtcatancggttacacaaacttttattaaggcgatgaagtagagatgaagtttaatgagatatggataaatgaatatttggcgctcgtaaatgatgataatccaatacataatgagattgtgccaggacaattagtgagtcaaatgatgctgatggctatgtcattagagacaaaccagtgtcaaattaactacgttaaacctattttaataaatgaaaatatcgaattcattgaacaacacgaacacgaaattatagcaattaatgacgatggagagattaaaataaaaatttctttgagcacaaaaaaataaccgatattagctgcatgaacgcatattaattaggagatgaaaggacagctaatatcagttatgtattgttattattattgggaacagagatgaatataggttacgtttctttctttgcacggggatgcattaatctaaaataataataacaactatatcaatgtttaataaattctggattattggaacgattagtcaatttaactaacttncatatgatctatatcgtcttgtnataaagagagcaatttgaatatttcagtatcactaaatgaatcgncacatttaattgaaacatgctgaaacgtttgggttataatttcataaactggtgcgccttcatggtgatactgtcgaataaataatcataaccatatttacctccttnggctactctatgggtatattataaataacatttttatgtgtgacatcaaccttaagtatcaactttttatcagacatagaacgtangatttactaagactatttatgtataaaagttctaaataaatatatatttatagagtcgcctggcagncatttgggaaatataacatatatgattagagaggcatctatcgcaaaagaatgataatgatagaggtattgagcatatagatgagtttaagttcatcttgaaaataaagggttatttagtcatagatgtagatgtataggaaatatttgtatgtattgntcgatatgtatgaaattttcaataaaagctaataacgcttatatgtaactttcaaatttaaattatatacagagcatgatgattataaaaaaatanccacatcacataaattgagttcatacccaatttaagtggtgtggctaataatgttgatttatagatgaaccgcctaatcgttaaacctctgttacttcaacatcgatatgttcaatacggttgtatgcaccgtgatccacaggaccaacaaaatcattcattttccaaccgtttttaatagcagaagcgacgaaagctttcgctcgtgctaatcacagcttctttcggtgacttaccgttagctaaatatgcaggtgttgccgcagcaaatgtacaaccagcaccatggttataactttgttggaacatgtctgttgttagttgataaaatgtgtgaccatcatagtataagtcatacgatttatcttgatctaaagctntgncacctttaatgatgacatgctgtgcgcctttatcaaagataattgntgcagcctttnacatatcttcaattgaatttaatttacctaatcctgataattgacccgcttcaaataagtntggtgtcactaccggtggtttaggtagtaaatatttaatcatcgcctcagtatttccaggattaagcacttcatcttcggcctttacaanccatgacaggatcttactacaaaatattgtgcaattagatgctcatatacttctccagnacgggtggatatctcctcaag

SEQ ID NO: 192 - DNA (Genomic DNA), 479 bp; single-stranded, linear
tttcccccnactccataatcttggccaaaatcatgtttaaatttgatcttgatttggacccaaagatagcttgcatattgtttcccaacttctaanacacctgatgcgcctaaagctttaaatacctgctacatctacttttgatttatccaacccacttctacgcgcagacgtgtaatacatgcatctaaatgtttaatgttttcttttccaccccattgnatctaagacatcanatggtaattttgcgacactagagttacgaatttcagtttcttcatcttcacgacctggtgttttcaatttaaacttacgaattncacagtcgaatgagangtaanacacgatagcagacacgacagcgttctnngactggtaatngggcattnngcccaacccaatttatgtgagctaactcaggttgaacnttgaccatctttnnattcttcaacccanaacctgcaggcgtattcataant

SEQ ID NO: 193 - DNA (Genomic DNA), 2593 bp; single-stranded, linear
ccaaagtgttctggtctaagatattatcgctaatccgtgttaagccactcagctgtttaatatcaattacctttttnaaatccctccaacctaaaatcttgattcccaccttgctttaataaaatctttcgttttagttgtattatgtttaaacttcttgccagtcttttcggtaagataatcaataatctctttatatgggatgcgtgtcgggtttcccgacaatatatctactctatttatattgttattacttgtattattaatacttgtattgtctctttaacatttgtgataataggggtattaacagaattgttaataggggtattatcatttgtgttaataggtcttatcatttctgttaaggggtatagctttctttgtttaatttcattaccatttctaatgatttcaacatgtaaatatccacattcttttaagttggctatacggcgtgatacagtaacttttgtaacttcatatagtttcgcaaagtaaccattacttgctgtgcagtatccgtacttgttacttaaagacgttatttctgcaaaaagtaacttttcgctgtcagtaagtcggttatcgtatctgacatttgccgttattattgagtagtaacttggttgttcagtcattctcagcaccttctttcagtgctttgaacttgtctggtatctcccagttagatatgaattctttcaattcatcagtcataggtacttcgtttagtattgcgtcatcaccaaacagatataaaactatcttgttatatgctaatgccgctttttctgtgctatcaaaatattccgtagtatatagcttgccatcaatttttttcctaacagaaaatcgatgcggcatatcagagtggtttccaattcctctgtagccatatttactagcgtttcttgtgttgttaatatttttatgaggaaaataatctctaactttacgcatatctcttccaattatgtttttaaaaccttccaccaccccaaaactcatctacagcttngttatacgcttcagctgctaattcttcttgtttnaaaaatacctaaacgttttnggatttccttcaacatttatattggctgtccatttattgcaatcttnacgccagttaacacctttanacttagaagaaccattacttttaggtntctcccatcttgancngttnnnaccttttgtagttaaattagatttagtaaaattattatttttaattttttgaaaacttccttcttttataaaggttgttaatagtacaacctttctctcgttgccaatcctagtatggatatatcttgtattacctttatagtatttgaaccatttatatctgttccactctttcataatcttcatcatcaacaaaaatttcttctccatcttgtaaaaatatcgatttaaccattattctcttcctttcagcattttgttgagcctctcatcaacttttatccacgagtcatgcaagtgatatttatcatcaaacgacttaacaccaatcgcatgttgctcgttgtgatgttcgcgacataacgctaatacatgtttgttgtagtgattcattttgtttctgttcattcctctgccgactgcttcataatgcgctaggtctgcgtgaggctttccacaaattacacagttgcggttgattgtagcccaatacaatagtgctttatcctcacttaacaacttgctctcgtgcctatgctcataggtatttgatgatgaaacataaacgctataatcagttctattaactcccttgcaactttcatagaacagtcgcgcagactgatttcttcataacctttcataatttccaattctgtttgtaataatttnctaattgattccaccggttctccccagtgaagttctatatctctacacatngcgaatatttttttgcgttgttctatagatagttttttattatccggaacctctacttctgcttttagtggatatccgttttctagtaagtcaatgtgactttgttcaagttcaacaccantagcaacgacggaataagtnccgtcattgtcnntctggnatcttgtaatgtattgcanntaaacccacaccttaaacgctaaatcttggtcgtcatatccaaattgccccctgctttcaaatggattgctttgttgagacattgatgtttgttgttgtgccccgttattttcttcagctttttgcttatctgtcttcggaataggtttgttaacaacatcatcgccctttttgtaaggtttaataaatgaaaaatccgtaaaatacttaccttcatcttcattgaatttccatttcaataccaagtgacanaacttaccaataagatcattggtatcanaatctaagctaggaagatttaacttaatacctaatcgagtaactaattcaatcaattgtttttcttggaaatcatatttatacggcggtacaaattgattatgtttatattgtttgccttcatcattttcaaatacgattgtgaaatatctattttctctatcattagaagaaaacctgatcatcttttttaggtttcttagattggaattgttgaggg

SEQ ID NO: 194 - DNA (Genomic DNA), 3191 bp; single-stranded, linear
ccccaagtctcatatgaagtagttggattagttccgaagtatgaggatgggaatttcttgacatagtaaagtgccggatgatagtgcaagaggtatcgttgcacaaaatatgacaactgctgagattgaaacatttggttcagatccagttattatgccaacggggtgcccctggtattattttcggtaaaacaacaaactcaatgattaatacaggatcagcggcttccattgtttaccaacaaggcgctatttatgctaatgctgagttcattcaaattcatcctactgcaatccctggtgatgataaactccgactaatgagtgatcagcaccnttgttgaaggtggacgaatttggacatataaagatggtaagccttggtacttctnaagaagagaaatatcctgattatggtaacttagtacctcgtgatatcgcaaccgcgtganattttcgatgtatgtattaaccaacaaattaggnataaatgncgaaaacatggnatatcttgatttgtcacataaagatccaacatgagttagatgtaaaactaggtggtatcattgaaatttatganaaattcactggtgatgacccacgcaaagtaccaatgaagattttcccagctgttcactattcaatgggtggtctatatgtagattatgatcaaatgacaaatattaaagggttatttgcagctggagaatgtgacttctctcaacatggtggtaaccgcttaggtgccaattcattgttatcagcgatttatggtggtacagtagcaggtccaaacgcgattgattaatatttcaaatattgatccgatccatatactgatatggacngaagtatttttgaaaaacgtaaagctgaagagcaaggaacgttttgataaattattagctatgcgcggtacaagaaaatgcctataaattacaccgtgaacttggtgaaattatgacaccaaatgtaactgttgttcgtgaaaatgaaaaactgttagaaacagatnaaaagattgttgaattgatgaaacgttatgaagatattgatatggaagatactcaaacttggagtaaccaagcggtattctttacccgtcaactatggaacatgttagtacttgcacgtgttattacgattggtgcatataaccgtaacgaatcacgcggtgcccattataaaccagaattcctgataagtattttcgtcagaagtacataatatttaaatcatttaattttgagaagcatggaaaattttggaacaaatggttttacgtaagaaaatggaaacataagattttagatggtcatcagcttaatcaaaatatatatgatcagcgtcatttaatgacaatcaatactgatgaaattgaaaaaatgattatagagacaaagagggcagagttgattcattggatatcgatacttccagtcatcatattcaataaaggctctcgtttagtaaagtatataaatattttctatgcaatgatagctaatgttccaatcattattgtgcaacgctataatcgacgagattaacgcaggtactacgcattttaaaacgaagaggtgaacgtcatgactaaacatatcatccgntattgggtgggnggcttaggtgggatttcntgcagcaattcgaatggacaaaagtggctattcggnctcattatatgaacaaaatactcatataggaggcaaagtgaatcgncatgaatcagatggctttggctttgatttaggtccatctattttaacgatgccttatatttgtgaaaaattattcgaatatagcaagaagcaaatgtcagactacgttacaatcaagcgtttgncacatcaatggcgtagcttttttccagatggcacgactatcgatttgtatgaaggtattaaagaaacaggtcagcataatgcgatattgtcgaaacaggatatagaggaactgcaaaattatttgaattatacaagacgaatcgatcgtattactgaaaaagggtattttaactatggtttagatacactatctcaaattattaaatttcatgggccattaaatgctcttattaattatgattatgtacatactatgcaacaggccatagacaagcgtatctcgaatccatacttgcgacaaatgttaggctattttatcaaatatgtaggttcttcatcatacgatgcgncagctgtattatctatgttattccatatgcaacaagagcaaggccnttgntatgtagaaggtggaatccatcatttngccaatgccttggaaaagctagcgcgtgaagaaggtgtcacaattcatacaggtgcacgtgtggacaatattaaaacatatcaaagacgtgtgacgggtgtcagattagatacaggtgagtttgtaaaggcagattatattatttcaaatatggaagtcatacctacttataaatatttaattcaccttggatactcaacgattaaacaaattagagagggaatttgagccggcaagctcaggatatgtgatgcatttaggtgttgcttgccaatacccgcaattagcacatcataatttcttttttacggaaaatgcttatctcaattatcaacaagtttttcatgaaaaggtattgccagatgatccgaccatttatctagtaaatacgaataaaactgatcacacacaagcgccagtagggttatgaaaatatcaaagtcttaccacatattccatatattcaagatcagccttttaccactgaagattatgcgaagtttagggataaaattttggataaattagaaaaaatgggacttactgatttaagaaaacacattatttatgaagatgtttggacaccggaggatattgaaaaaaattatcgntctaatcgtggtgcaatatatggtgttgtcgcagataaaaagaaaaacaaaggatttacctttcctaaagaaagtcagtattttgaaaacttgtactttgtaggtggatcagnaaatcctggtggtggcatgccaatggttacattaagtgggcaacaantcgcagacaaantnaacgcgcgaagaagcgaangaatagganggtganatctattgaaatcggtnntcacgactatttaanagacaatagtggnnacccatcntcttntggggncttgggagcatttggatnttcnncgggggnca

SEQ ID NO: 195 - DNA (Genomic DNA), 1189 bp; single-stranded, linear
cctggaataattggtggtccgtaattgatgggccaagttgaaattggaagctaaaaaagtcttaatccgcccaaattgttaacaacacacctattgactttgtcaatccaacccatcaatccttcattattaacatgtcccaggtatctttaagnttgatgaaacattagataccagttgttggcgaaggcttaaagctttgccancttgaaaaattaagccggaattaagatgcattgcgtcgcctatttgaatccaaaccgatagtgttaaatatgataaattaaaagcacgttatgagcgtttccaaaatcaatcattcaaaaacttagattatgatttcgaaagcgtgcgtacttcaagacaatcaccattcgcgcaacgtattgaacaacaacaaaaacgtttgaacttaccggatttaccaacaacaactattggatcattcccacaaagccgagaagttcgaaaataccgtgcagattggaagaacaaacgcattacagacgaagcatatgaaacattcttaaaaaatgaaattgctcgatggattaaaattcaagaagacatcggcttagatgtattagttcacggtgaatttgaacgtaatgacatggttgaattcttcggagaaaaattacaaggtttcttagtaactaaattcggttgggtgcaatcatatggttcacgcgccgtaaaaccaccaatcatttatggtgatgtaaaatggacagcgcctttaactgttgatgaaacagtttatgcacaaagcttaacagataaaccagttaaaggtatgttaactggacctgtaacaattctaaactggtcatttgaacgtgttgatttaccacgtaaagtcgctcaagatcaaattgctttagcaatcaacgaagaagtattagcacttgaagctgcaggaatcaaagttatccaagttgacgaacctgcattacgtgaaggcttaccattacgctctgaatatcacgaacaatatcttaaagatgctggttttatcatttaancttgcaacgtcttcaagttcggtgatgaanctcaaatccatacacatattgtgttattctcaantcgggcaaatcaatcaatgctattcaagatttagattgcttgatgttattcaattgaacactccgngccntggggatttaattaagnttggaggttttat

SEQ ID NO: 196 - DNA (Genomic DNA), 3815 bp; single-stranded, linear
ggagcataataaagagcgtatcttaaacattaattttaagtgtgatcccaaagtaattttcgtgattcattgaaaattgttccgaaagnaccgttgttcatccaagacaatatttaccttaacaatattgatttggggttacctggaacgatgttattaagtttggttagctgacaaaaatagtcgttaccgccatcgcaggacccaatgccgattgtaatggttagcattattaaatcaatgatgcatccaaaaaatggaatatatagatgcaagtcatattgtgattgcgttgttaatcatccttgtgataatcacattgtttatcttattattcattgaattagtagaagtgagaataccatatatcgatttaatgaacgtttccgcaacaaatatgaaatcttatttatcttggaaagttaaccctgcaggcagtattactttaatgatgagtatttcagcatttgttttcttgaaaagtggcattcattttattttatctatgtttaataaaagcatatcagatgacatgccaatgctgacatttgatagtccagtaggtatttcagtatatttagtgattcaaatgttattgggttattttttatcgagatttttaatcaatactaaacaaaaatccaaagatttcttaaagagtggcaattatttttcaggagttaaacctggtaaggatacagaacgttatttaaattatcaagcaagacgcgtatgttggtttggatcggcattagttacagtcattattggtataccgctttatttcacattgtttgtaccgcatttatctactgaaatttatttctcagtacaactgattgtattagtttacatcagtattaatattgcagaaacaattcgtacatatttatattttgataaatataagccatttttaaaccagtattggtaaggaggtaattatgaaatactttattccagcttggtacgatgaccaacgatggtggcaagacacgactgtgccgtattatcaactacaaaataagacggaatttgacgatatgattagtttaatgggaatgcaccttgaaaatgacttagattatcaactgattgttctcaatcatgcaccaaatttaagaacatttttacatcgatatgacttatatgaaacaaagtattcgtctgtgtttgatgaaattcaaggattcagtcaccatgcgccacaagcgattaattatcatcacttaaaatggncggatgatgttggagtntgggtacacgcccgnatttattaaaaatgtgtgacgagtgaacagacctatacanatatttatttnagncaagaagggtattcanttgggtttgnagantgattngaaagagatcaagtnacaacggcgttatatttttgatgacagaggttatttatcagcgatacgttattttgatgatcagggagaggcttcttaccaacaatatttaacggattaatggagattgtgtaacttcatggaagattgganaaatggcaggagtcactgtatcnanaaggatattcaacatcactatcaacaaacagaatataacaatatggctcaactaattggaagaaaaatttcaagcaatgattgcacaacaaatacatgaagatgatcatgtgattgtggcttcagatgctaggcacaatcgacaaatagccaatcatattccagcgaaattgttaagttattcattttttaaaaatagaaatgaanctgtgtcagatgaggaatatcaatctatcgtaaagaatgcccatttaattgttgatagtgtgcaactagaacgtgatttaattagtcatcaagagaagtatcagcgggagaatacaatgattcgaatcacaccatttgaaacgagacaatcacctaatataagtagtcaattgatggaaacatttataggtgtatggatagatggtatgagtgacgctgatttgcaacaaatgatgcaacgacttgtggattatatcgcacaggaagattattaccgtttaattttattatcgcgccatcaaaatgacataccgatgtggcttcgtgaatgtattacgtcggtaaatgaggaataccaagctaaacagaatgcggatgttaatgtttcagcattaatgacacctgaagatcaagatgacatcattgctgttaagacgatacatgctgaacatgatgttgtagaagcattgcggacgttgcgacttgtgatagatatgtcaaaagaacctgatttgtatttacaaattagtgcaattagcgctgggattccacaaattaatggtcaacaaacagattacgtctctgattatgacaatggccgtattataaatacagctggatgaattagatgatgcgttaaattattatttattttatttgaaaaattggaattatgcgtacgcctattctttaaaattaatagatgcatatgcttctaagaatattattaatcagctcgatgagttaatagaaggtgaaaatgatgccacgtaaatttagagttttgcaaattggaggagacgatttagaacctatttttcaacacaaaaaaggtgtgagttgggattacttcgatattggattgtttgaatttgatagtggttatgtagaggctattgaagcgattgttgaagcagaagggcgctttgattttatctatattcaagcaccatactcggagacattaacgaatttattacaaatgataagcgaaccatacaatacgtatgttgatgaatcattttggtcagttgaatatgaacaagacgaaaattgtccaaaaatacgttgttcaaccaattacattaccggaatattggaaggaacgtaataatnaattagaggcaggntagcttctcaaggacaaggattggagataaagtttcccctaagttagcacttgtgcatccgaattttaaaggagatgtcgaatacccaaggtaattcaagagctcacgttgagtggagaatttggaaaagaatttaaacctatcgcatcttgncaaaataatctcgtttacgataaagataaagtcattcanatatggccagaatttgatattgatggtgcggtcgagttgcaatatacatttagattgattcagactggcgctgatggtgcattaattgaacaaatcatattaactgatgatatgttagacagtcctttagagatacctgcgaaaccatttgatgcttatataagtgtaactgttaaggcgcgtgggaacgggacggtacatttaggacctaaacacacacgatggtccagantagananggntcaatttttacntggtgggaatcgtttcgaagatanncnccgncnggaatttaattattaatcccnccctggtgatatganacccccactaaacgtaaattttagtggttatcgancaccggaaggtttcgaaggatattatatgatganacgtatgaatgcnccgtttttacttatcgccgatcctcgtgttganggtggtagcttttatatcggttcatctgaatatgaacaacgtgattatcaatgttattgacgagacaatattcatgctgtaaatccaacatcaggtgcagctggtaagtatcaattcttacaatcaacttgggattcagtagcacctgctaaatatnaaggtgtatcaccagcaaatgctcctggaagtgttcaagatgccgcagcagtaaaattatataacactggtggcgctggacattgggttactgcataagccatttatgcatagctaatcaatagttatataagtaacttttagatcggaatatatcggg

SEQ ID NO: 197 - DNA (Genomic DNA), 2848 bp; single-stranded, linear
ggcncgagacgcttaattatggaacnccaagatgcnattggacncggttataacattggnacaggcacttttactaatttattagaggtttatcgtattattggtgaattaaatatggnaaatccaatcgagcnttgaatttaaaggaagcacgaaaaggagatattaaccattcttattgnagatatctctaacttaaaggcattaggattttgtgctcctaaaaaatacagtagaaacaggtttaaaggattactttaattttgaggtagataatattgaagaagttacagctaaagaagtggaaatgtcgtgaaaatgacattgaagctgtccataataataagggttatgcctatcaaagaaaattagatgcactcgaagaagtgagaaaaggctattacccaattaaacgtgcgattgacttagtattaagtatcgttttattatttttaacatttccgattatgttcatattcgccattgctatcgtcatagattcgccaggaaaccctatttatagtcaggttagagttgggaagatgggtaaattaattaaaatatacaaattacgttcgatgtgtaaaaacgcagagaaaaatggtgcgcaatgggctgataaagatgatgatcgtataacaaatgtcgggaagtttattcgtaaaacacgcattgatgaattaccacacctaattaatgttgttaaaggggaaatgagttttattggaccacgcccggaacgtccggaatttgtagaattatttagttcagaagtgataggtttcgagcaaagatgtcttgttacaccagggttaacaggacttgcgcaaattcaaggtggatatgacttaacaccgcaacacaaactgaaatatgacatgaaatatatacataaaggtagtttaatgatggaactatatatatcaattagaacattgatggttgttattacaggggaaggctcaaggtagtcttaatttacttaataagttcaaataaaagttatattttaaagattgtgaccaatngttacagtntaacgaggantcccttgngacngtatcaaatggcattaaagaaatatgtnccatcntttgatttgcntggccaataaatactattcatcttgatgagataagccatgttaagaaattgaaagtatagcattaanggggtttgtaacagttgaaaattatatattgtattactaaagcagacaatggtggtgcacaaaacacatctcattcaactcgccaaccatttttgcgtacaccatgatgtttatgtcattgtaggcaatcatggaccaatgattgaacanctagatgcaagagttaatgtaattattctcgaacatttagtaggtccaattgactttaaacaagatattttagctgtcaaagtgttagcacagttattctcgaaaattaagcctgatgttatccatttacattcttccaaagctggaacggtcggacgaattgcgaagttcatttcgaaatcgaaagacacacgtgtagtttttactgcgcatggatgggcttttacagagggtgttaaaccagctaaaaaatttctatatctagttatcgaaaaattaatgtcatgtattacagatagcattatttgtgtttcagatttcgataaacagttagcgttaaaatatcgatttaatcgattgaaattaaccacaatacataatggtattgcagatgttcccgctgttaancaaacgctaaaaagccaatcacataacaatattggcgaagtagttggantgttgcctaataaacaagatttacagattaatgccccgacaaagcatcaatttgttatgattgcaagatttgcttatccaaaattgccncaaaatctaatcgcggcaatagagatattgaaattacataacagtaatcatgcgcattttacatttataggcgatggacctacattaaatgattgtcagccaccaagttgtacaagctgggttaagaaaatgatgtcacatttttgggcaatgtcattaatgcgagtcatttattatcacaatacgatacgtttattttaataagtaagcatgaaggtttgccaattagcattatagaagctatgcctacaggtttgcctgttatagccagtcatgttggcggtatttcagaattagtagctgataatggtatatgtatgatgaacacccaacccgaaactattgctaaagtcctggaaaaatatttaatagacagtgattacatcaaaatgagtaatcaatctagaaaacgttatttagaatgttttactgaggagaaaatgattaaagaagtggaagacgtttataatggaaaatcaacacaatagtaaattactaacattgttacttatcggtttagcggtttttattcagcaatcttcggttattgccggtgtgaatgtttctatagctgactttatcacattactaatattagtttatttactgtttttcgctaaccatttattaaaggcaaatcattttttacagtttttcattattttgtatacatatcgtatgattattacgctttgtttgctattttttgatgatttgatatttattacggttaaggaagttcttgcatctacagntaaatatgcatttgtagtcatttatttctatttagggatgatcatctttaagttaggtaatagcaaaaaagtgatcgttacctcttatattataagcagtgtgactataggtctattttgtattatagctggtttgaacaagtcccctttactaatgaaatcgttatattttgatgaaatacgttcaaaaggattaaggaatgaccctaactatttcgctcgtgcc

SEQ ID NO: 198 - DNA (Genomic DNA), 2144 bp; single-stranded, linear
ccccaaagaaatacanttgttggtagaagaacccccaacccacaagntggggacccttcatttccaaccntatggcggagggttaaagtaaattcttgaagctttggttgcccncaaataatatgatatttccgaaatgggccggagccgtatccaacaatttaaaatctgccggaggtattaaagcattacttaaccgctccgattaagatgnnattgaaggagagattaatatggtagaatcaatgctaacttttatgcttgggccattaagacaaatcnctgatttttatatggaacatttactcgtaagtaattccatcgtcattgcaggttattttgcgacaggtatttttaaaaagaaaaaagttgtgaattaaatcanatttgaggtgatttacaagtgaaagcattgaaattatatggcgtagaagatttacggtatgaggataatgaaaagccagtcattgaaagtgcgaatgacgttattgttaaagtacgagcgactggcatatgtggttcagacacgtcacgaaacanaaanatggggccatacattaaaggtatgccatttggtcatgaattttcaggtgtagtagatgccattggaagtgatgttacgcatgttaatgtgggcgacaaagtgacaggttgcccagcaataccttgttatcaatgcgagtagtgtttgaaaggtgaatatgcacgatgtgaaaaagttattcgtcatttgnctcaatatgaaccttggatcgttcngcggaatatgtcaaattcccaccccaaaatgttttnaagggttccaagccaatgttgattaccattgaancaaccaatggtttgagccatcagcccgttgttgcgcatgggttttataaatccgaatanacaacctggtatgactgttgcagtaatggggtgtggcagtataggtttgttagctattcaatgggcacgaatatttggtgctgcacatatcatcgctatagatatagatgcgcataaactagatattgcaacatcattgggcgcacatcaaacaatcaattcaaaagaagaaaatcttgagaaattcatcgaaaatcattacgccaatcaaatcgatttagctatagaatcatcaggtgctaaagttacgattggtcaaatattgacgctacctaaaaaaggtggcgaggtggtattactcggaataccatatgatgatattgagattgatcgcgttcattttgaaaaaattctgcgtaacgagttgacagtatgtggctcttggaactgtttgtccagtaattttccgggcaaagagtggacggcaaccttacattatatgaagacgaaagatattaatgtaaagcctattatttctcattttttaccgttaagaaaaaggcccggagacattttgataaattagttaataagaaagaccgatttgataaagtcatgtttacgatttattagtatgcacctttgaggacgaaaacgctggtatagttatagctatgaaagtgcgaatgccgtctggtctacagatactatcgaaataattcatcttcgaatatacgttgataaatagccggtttacttgtgtgaaatatgcttgtgaatcggttgttttgcattttgtatacttaaaatgagatggcaatatttgataatttttaaagtgaaaatcaagtacagccacttaataagataaatttattataatatatggtaaaatgatggcagtaataatgaatttgaaaaagagtaaacattaatacctttaacaatttaatatcgtcagagttaatgattaactgcatggcaaaacaacttagaatggtcagttacnnaaatacatttttataaaaaattatcacactattgtgacaactatctttggattaataaaagaggcaagtgagcaataggttaggcttatgtgcgggcataggtcagtaatgtagaaatggaaatgatgtaatacgttaattcgtttgaatctttaaaagtattggataaatcagataatcgcctgttatacgcatcaatcaatgttttatacataaatatgtctgatatttctaagtcgttatttttgaatggaataaatggaatcttaccccacgaccctgtactaaaatgcgtttttrrdctns

SEQ ID NO: 199 - DNA (Genomic DNA), 2178 bp; single-stranded, linear
caaataacggaccctttngttaatatcccatntttttggcggagtatgggaccttagcagagaaaatagccataagataagatttcgccccanncgttggagcccaacttacattgtttgtagaatttcttttcgaaattctttgtgttgggcccccaccccaacttgcatcgtctgnagaaattgggggtccaatttcactgtgttgggnccccctgaactaaatagtatggaaatatatatatctaaataattaaaacggncaaatagtttaatatggcagtaacaatttttataatttagatattttgatatagactaatgcttaaattaagcaacttttctannnagggagtatgaaaatgattagtactttgaatgaaattatgaaatgtatcggaagaccncgatacaattattaatacacaagacatgttagaccagatccagatgcatatggttcacaacttggtttaaaatactatattcagcagaaatttccgcaaaagcaagtatttgcagtgggtgaagcggaatcatcattaagttttattggagagttggataacattgatgataaaacatatcaagatgcgcttgtaattgtatgtgatactgccaatgctccacgaattgacgatgaacgatatagtacaggtagtaaacttattaaaatagatcatcatcctgcagttgatcagtatggtgatattaatttagttaatacgaacgcgtcatctacaagtgaaatcatttatgatttaatctcacattttaatgatgaagcaattgttaataaaggcacgagcgagtgttttataccttggtatcgtcggtgatactgggcgattcctttttaacaatacctcagaacatactatggaaattgctggaaagttaattgggcatgatattgatcataatgcgctattaaataaaatgatggagaaggacccaaaaatgttgccgtttcaaggttatgttttacaacatttcgaacttatggatgatggattctgccaagttaaaataactgaagatgtattggagcaattcggtattcagccaaatgaagcatctcagtttgttaatacaattgctgacatcaaaggtttgaaaatatgggtgtttccaagttgttgagggtagtgaaataagatgtcgcttacgctctaaagggcaattgattattaatgatattgcgcaagattttggtggcggtgcccatccggaatgcgtcaggagtttcagtgaacagctgggatgaatttgagcaacttgctacagctttacgcacaaaacttaactaatagaaaggagccattcaatcatggtggcatatttaaatattcatacggcttatgatttgttaaattcaagcttaaaaatagaagatgccgtaagacttgctgtgtctgaaaatgttgatgcacttgccataactgacaccaatgtattgtatggttttcctaaattttatgatgcatgtatagcaaataacattaaaccgatttttggtatgacaatatatgtgacaaatggattaaatacagtcgaaacagttgttctagctaaaaataatgatggattaaaagatttgtatcaactatcatcggaaataaaaatgaaaacaatggaaaatgtttcatttgaactattgcaacaattttcatcgaatttgattatcatttttaaaaatgttgcagacgaacatcgtgacattgttcaagtttgtgattcgcatgaagatacgtatttagatcatcaaagtgttttagttcagggtataaagcacgtatggattcaaaatgtttgttaccaaacacgtcaagatgccgatacgatttctgcattagcagctattagagacaatgcaaaattagacttaattcatgatcaagaagattttggtgcacattttttaactgaaaaggaaattaaacaattagatattaaccaagaatatttaacgcaggttgatgttatagctcaaaagtgtaatgcagaattaaaatatcatcaatctctacttcctcaatatcagacaactaacgatgaatcagctaaaaaatatttggtggcgtgtcttagttacacaaattgaaaaaattagaacttaattatgacgtctatttagagcgatggaatatgagtattaagttattactaatatgggtt

SEQ ID NO: 200 - DNA (Genomic DNA), 1528 bp; single-stranded, linear
tcatttttttgattgagccaaaaggagtcccccctgtgagcggaatatttaatttattgagctatttaatattaaacgtacgcttaacccccctanagtgatatcgtttctagcgttgtcattatcattaagcgaaacattttaaagacaaatacacactgtacgatcaccaaactgcatgtcgaacaatgtaacatttggattcgatatttaaaattgcttgtgatgataaactttctcatttagaaaacgcttccacgtacattcaaaaaaataactttgttaaccatattgtaacattatttcatatattttggggcatgagaatgattctcacgcccagtaatttatttatgcaattgttcatgtaggttctttgcgacgttttcaggaatacctatatttttaaaatcttcaagtgtagctcgtgccttcattttcttgattgaaccgaatgaacgcaataataatgttttaacgtttgttaccgataccatctatatcatcaagtattgatttcaagcctgtcttttgacgtgtttgtctatgaaatgtgattgcgaatctgtgaacctcatcttggatacggatgcaacaaataaaatgcctgcctatttttcttcagtggacaatttcctgcactagcgccataataataattcagatgtttggtgtttatcatttttctgcaaacctgcaacagggatatcaagacctaattcgttttgtagcacatcaataaccccgttcatatgtcctttaccaccatcgactattattaaatcaggtaatggtaatccttcgtttaaaacgcgagaatatcgtcgtcttactacttctctcattgatttgtaatcatctggacctttaaccgttttgattttatactttctataatttttcttatctggtttaccgtcgacaaatgtaaccattgctgacactggatccacaccttgaatattagaattatcgaatgcttcaattctaattggtgtttgaattcccatttgtgttccaagttcttcaatagctttaatcgttcttgactcatcacgtgatattaattcaaatttattatttaaggatactttagcgttatgtgcagctaggtcaaccatatcttttttgggacctcgcgcgggttgaacgattttagtgtccacaacagattgaatcatttctttatccaaattacgtggtacatgaacttccttaggtaaaatatgttggtttaagctataaaattgtccaataaatgtataaaattcttcttcttctgtttggtgtaatggaatcatcggngtatctcgctttatcatattaccttgtcggattaaagaaaacttggatacacatccatcctttatcaacacaataaccaaagacatcacgaatcggnttatctgatgacataatttngggtgggtgggcaagatttggatattgttggattaaatctctatattcttnagccgcncaaaatcaagtgattcacttggaggncacatncgctcttctaancttt

SEQ ID NO: 201 - DNA (Genomic DNA), 2933 bp; single-stranded, linear
aggttgatacatatgtcttgtaaatacatgtgtcattgcttgaccaattgcagcaatctggacccaggatnggtgcctacccagttatctccaaatttcacatttctgcgtaatctggtgctacttgaaatgacttttgtaccttaatagcggacttctgtcataaaatgtgcatccggagtacgtgttaaaggtacattagagccccacataataatgtatgatgcgttataccagtcacttgattcaggcacatctgtttgctctccccaaatttgtggagaggcaggtggtaaatctgcataccagtcataaaaactaagcatttcaccaccaagcaaattgatgaatcgagcacctgctgcataactaatcattgacatcgctggaataggtgtaaatcctgcgattcgatctggaccatatttttttattgtatacagtaattgtgctgcgattatctctgtaacgtctttccaatttgaacgcacgtgccctcccatacctcgggcttgcttatattgtttggctttgtcttcattttcaacaatagacgcccatgcagcaacgcgattaccatagttttcttctaatgcttcagtccataaatcccagagttttccacgaatatatggatatttgattcgaagcggactgtattcataccaagagaatgacgcacctcgtggacatcctctcggttcatattcaggcatatccggaccacaacttggatagtcagtttgttgattttcccaggtaatcacaccatttttcacaaatactttccaagaacatgagcctgtacagttaacaccatgtgttgttcttacttctttatcgtggctccaacgttctctgtacattttttcccattctctacttttactttctaggatcgaccaattcccattaaattttctgttggcttaaagaattcaatccaaattttcccatatttatatcctcctacgtataaaaaatacgatgtgtagatgtcgtgttnttaaatactttaaaatgcccaagactattgctttaattagattgtacattttttcacaaatataaaatattagggaatcacctaattacttaaggaatttccctatcaataacgggatttcattgaaataatacacaatcatgtatggtcgtgcttattgccaatctaaatcgttcaaatttgccacaacgacaaataaggcttcaacacgaatatattctctcggttgaaaccttacttattcatttattttttataaattagtgacataacactgtattagcatctgcacgatcggttgaaatatatgttacattttcttgctgcttaataaatgcatcatagtaatcatattgccgaccggaatgatatgtcccattcgatgtatcatttgggtttagcaaacagccataaccttcgtcatataaatgttcacagagcataagggcgtcatgtctagaaccacttactacataaaattgctgagtcggattagaagttgttgagacattttcagtataacccactacttcgcctataatacatatacctggtttcgcctcaattgcgtaatgctccagtttcccaacaatattacttaaacgccccttaacaacaaactcgttaaaacacgatgcttgaaagacaatcgctatcggataatcaatatctgtgtactgttgtatctgggcgataattttccctaaacgtttaactcccatatatatcgccaacgtaccaccatttactaaagngttgacatctacgtcattttcttctgaatctntnaagtgacctgtagaaaatgtcncactcttagcaacagcacgcntcgntaatcctgtttgcatcgtagcagctgcagcactcgcaagatgtcacaccaggtacaatgtcanacgcaatagtaaaagttgtttagtgtgtcaacttcttcttgaactcgnccaaatattgctgggtcgccacctttaaccctcaccaaccttgttatatcgacgtgctgcttccacgatacattcatttattttttcttgctgaatgtgttttgcatacggctttttaccaacatcgataatttcagtagtcaaattcgcatattgtaaaattaacggattcactaatcgatcatatagtataacatccgcttcacgtattaaacgctcagcctttttagtcaaataattcggattacctggtcccgcacctatcaagtaaaccttgccatatttatctacagacatatatatacgttcccgtctgtaacttctacctcataaacatctacacaaccttcatcaggttcttgtacaatcccagtatttaaatcaatcttttgatcatgaagtggacagaatacatattcaccactcactgttccctctgacaatggtccttgtttatgcggacaaatattgtggaatcgcgtganttgtaccactttcagataaaaaccaatcctacctctttgcctttgncaataaccttttttccaattaggggtgttaattcatctatagttgtcactttaattttttcttttgtttccatgtattacaccttctccacttcaaaaattttacgtgcttgcgcattgctagntattgcttcccaaggttcagcttcgactgcttttttagcatccataatgcgttcaaatagttcattttgtctttctgggtcaagtaagacttcttttacattttcaaatccaagtcttcttaaccatggcgctgttctttcagcatatatacctgtttcgcgatatagtgcatcaaagcaccacataatgtgnttacttcatcttctgtttctacagttgttaaaaattcagctttttcgacttctgtaccaccattaccaccgatatagatttggaatccattttcaactgagataataccaaaatctttaacacctgattcag

SEQ ID NO: 202 - DNA (Genomic DNA), 1866 bp; single-stranded, linear
taaagttcnttcccctgctnaatgtccaantttcccccatagcaactttcaaatatttttcatgacttgctttagcccaatcaagttctttacctgaaggtatattaaattgatttgttgaaaagttccaaaaattctgcgcttgggtaagtccttgtgggacaattttttgaaatcctccaacttcttaaatatttctggtgatttttgattaaaactcacgtaatttacgtagtttctcttctaattcatgttttttgttgacctaatgtttgtattatttgttggttcgatgaaatggcttgctgattatcggaagcatgctttttcaaattgttagttaaattttcatatcgcgtaatttgttgacttaatgatctgatatcttcttcaagctctgattcttttaaagatatgctatcaacctcactcgtataacgtgacacaaaattatcgcaagcttgcttcgttaaatcactcaatgttttcatacttgttgataatggaattaacaccgtactaaaaaattgcttagctgacgtatacgctttccctttaagcgcatcatcattgataaattgagtaattgctttttccaacgcatcataatttgaattcattgtttgactcaaattccccacacttgaagcttggtttcgagatctgtctaaatacatgtcaatactcatcggcatgctcctttttcaaaaatatatgattttcaaactatttaaaatcaaatgctttttacatctacaaagttgtaaaattttaaaactcggcgatgattatttcttatgtaaaggagtctagatgcaggtaaattgagataacatgtcgccttttttcttattttagcatatggatataatggtgtctttgtatattcgcaattaatcaataaaaattatctttcaatattttaattttattgcgacaacatccttaacattaaatatattaatatctcaaaatatattcactattaaaatatgtcatcagttgttaaaagtatttcctcatcatgcgaaatatcaaaacgtatctaaaatacgaatagtttatcaatcacacaacatcatcatccaaaatttnattgctctcatntncaatattcatttcatatctatcagttcatacataattaaaatttcaattgtgcaatctcaccgttaatgcatcaactttcaaacaataaatcatcacaataaccacacctaattcaacacttttcaaacataagtattgacacattgagcaaaatgatttttaattgtaactaatacagttacaattatgaggtgagaaacattgaatttagaatttaacattgccgtgcatgtattagcttttttaactaagcatcattcagaaaaattcaatagtagttcattagcagaattaacttgtttanatcctgttcaattacgacgcgtgacgactcaacttgtcgatttaanaatgattgacacaatacgaggtaaagatggcggttatttagcaaatgatcaaagtgctgatgtctctctagcaacattatataaacattttgtcttagagaaagaacaacacacacgtctatttacttggcgacgaaggcagtcactgtcaaattgctcgtaatattgcaactaccatgtcacattatcagcaagacgaacagaatatcattattaatttttataatgaaaaaacaatcaaagatgtcattgaagacattcaaaaggaggatttatgtcatgaaaacatatgatttaattgtaataggatttgggnaagctggtaaaactttagcgaaatatgctgcatcaacaggtcaacacgttcgcaggtatcgaacaatcttccaaaatgtatggnggcact

SEQ ID NO: 203 - DNA (Genomic DNA), 2990 bp; single-stranded, linear
acaatgcctccaagaggtacanccgataactgtctcacaaaactaaataaatttaactctgtgtcctcttcccatccgttcactttaatatcttctccataagcatcaacggaaagataaaanccggacctggaaatgtatgtgccatctctttaacccaatcagtatcttgaatgcctttcgntcccaacctatgcaataattaatccctgcggcaaagtagtccatgatttggtgacttcgtacgaatgccaccacctacttcaatatctttggttgttaatctcctcaatgacttaatataatcaaactctcgggcatactgtgccttagcacctatcaagtcgacgatatgaatacgattcacacattcaaattgactatagtaagcaatacttccttcagccgaacgcgacattttttcttcactatcatatttaccctctgttaacctcacacttgttgacccaatcaaatcaatcgctggccataattcaatcatttataaatcccccttgtattgcctgacgcaaaatttgtaacccatatgtaccgcttttttcaggatggaattgaataccaatataattgttaaattgaacaattgccggaatatcagccccatactgcgcatatgcaatgacattttctgacatcggcgcttggtaagaatgtacgaagtaaacatcttgatttaacataggatgcttactcactaaattattccaacctaagtgcggcactgggtattctgttgggatacgcgaaatatttcctgggataaaccctaatccagatgcatcgccttcatcactatgctcatacattaattgcatgcctaaacaaataccaatcatcttcttatcagtattcttagccaatattgcattgagatttaatcgttttatctctgacatcgcatctttaaaatggccgacaccgggcaatatgattgtttctgcttgatcgattatttttgaggtatttgagacaaccacctcataccctaaatgttcaatagcgcgttttacattactaatattccctaatccataatcaacgatgacaatcattcaatcacacctttcgatgacggcacacgctgatcatcagttgcagttagcgctatgcctaatgcacgggaaaacgctttgaatatagcttcaatttcatggtgtgtattacctccacgaattaaatcaatatgcgttgttaatcttgcattgattacgaccgctctaaaaaattcttctactaactccgtatcaaacgtaccaactttttctttacttaatgatgcattgaatgataggtatgggcgcccacttatatccacaacgacacgtgctaatgtttcatccattggaatgtacatcgttccataacgaacgaaatgctttttatctttaatcatttcaagtaacaattggccaatgacaatgccgatatcttcagttacatggtgatcatctacgtcaatatcaccttgtgcctcaatgtttaatgacagaccgctatgaaatgtaaacaatgttaacatatgatttaaaaagcccacacctgtattaatatgcgatggtgactggtcatctgatattgaaatatttagttggggtttcagctgtgtttcggtggttgtgaataaatcatattgtgcgctccantctttaacaatntcttcctaattgctttaactgcgatgctgttgcaattgagtatcttacatagcccttcatcaaccggctcaacataaaagcgaggtttaaatccttgttcaaatacgtattgtcctaattggtgcgctgctgaacctttagtaagtacaaaattggcatttgatgggaatactgacattttatctgcaacatgtgtatcaaatatttgttttaactgctcagctaactgtcgttgcatcgttaaaaatactcttgtctcttctctatgtctaaaaatataagtcgcaatatttagcgtaaatacatttaatggatatggatgttctattttttgaatatgctttatcgttccagcagtactaattaagacacctaatcttaagccggcaattccaaacgcctttgataatgtacgcattcttaagatgtgtggtgccagttccacgtcatatgccgtaccataatctaaatatgcttcatcaatgacaaagtatccgtttaatgctttcatcttatctgcaatagctgttaaaaatgccgnatcaaattgcttgcctgaagggttatgtggattactcataataaaaaatgatggntgtncttcatcgattttcgttaaaatggtttccaaatcaaacgtnaaatctgatccngcatcttacaaatgcaatttcacgatttacttgtgccgcatatgcttgatacataaaaaaatcaggatttagcgttaatgccggaccttctggcatgatcagcattaacttttgantcanttcatcagatccatttcctgcaataanttgttcaggcgataacccgtaaaacttagcatnagcttccgtgaattgttcatatgctgcatcaggatataaattatatggcgttgcactaataatagacgtcattgttttttcatccaacggcgtaactggactttcatttttatcaatataaatcatttcaattacactcccctaagactgacgtattaaaatagactgctggtgattgtataatgcttcaacatgagcaatatgttgtgctgaatcagcaatttgttcaaacgtatcttttgataaatggatgaccgtgttccgtgttaagaaatcattgaccgataacccattggtaaatctagctgttctatttgtaggtaatacatgacttggacctgcaacgtaatctcctatgacctctggcgaataatgtccaataaacaatgcacccacatatttcacttncncaatatatggntgaggatttactgtgtgaatcgacgcatgttcaggcgcgatcgtgcctttcatgacatgg

SEQ ID NO: 204 - DNA (Genomic DNA), 3386 bp; single-stranded, linear
gcatcggttaaatggcgtcattccacttacgggcatcttnaggcattttgcttttcaagtggctaatttagcttcaccgtttaaggctatttttagcatcagtcacttgagttaatgcacggagtaatgtcatctgggttaagcgttggatttgtcgtttgattgataataccttccgcttgagacactgcatttgtatatgctgtttgcttatcgacatcagcatcgtggtagttctcacttgctttcacagtatctttatttgcaataccttgtttcaagttacccattgctgtattcacattttgtgcatttttgtttagtttgtccaacctgtagctaaagcttgtgcttgattganttggtttcgtaatgcatcacgttgtggtgatttaagtcacgtnacgtatcaagatttgctaaagcatcttgtttcgcttgcgctaatttttcatcaccgtttaatgcatctttcgcttgattcatagttgtaactgcttttgttactgtatcaggcgccaatacaggtgttggtgtgccatttgcgatttgttgcgcttggttagctgcattgttataagcttgttgtttgtcttgatccgcttgtgtaaagtcaactgattgtggtacttgactattcgcttgaatttgttgtgtcaacgtacccattgcattatttaacgcatcagcattttgcttaatagcattaacacctgtaacaagttctgcatgcgacacttgggtcttttaatgctgttttttgtggttgatttaagtttggtaactgatcaatggctgtatttgnattgtctttagcaacttgtaagttatggttaccgtttaaatcacccttagctcgagccacttgttgtaacgcttgagccacttgttgtggacccacgcttgcatttgggtgnaccactaatgatttggtccagcatgcgctaccgcatttgaaaaatgcatttttgcttatcagtatcagcatttgccaaagttaccatttgcttnaggtggtcttaatctgcaataccttgtntcaattgtgtcattgctttganntaaatctttgtgctgtttgcttaatcgtgttnacatttgcaacagtttgcgcagcatcgacttgttgtttaaaggcatctttgtgcgctggatttaaatcatttgcatttgtaataacttgtttcgctgcatcttttgcacgttgtaacattgtcattaccattcaatgcttgtttcggcttcgttcacacgttgcatcgcttgtttccaacttcagtttgaacttgcattgctgccatttgctttagataaaataccttctgcatgtgaaaccgcattagtataatcatctttcttagctngatctgcatcagtaaagttaatgctatctaatgtctcagttttatcttgtaatgcattgtttaagttagtcatagcattattcagattttgagcattttgcttaacattattaactgttgcaatatctggtgcttgttcaacttgagttgttagcgcttgtttttgagcatcatttaaatgatctagtgtaccaagtgttgtcttagcatcttgtttggcatcagctaatttgtgattaccgttaagtgcttgatttgtgtcattcactttagttaatgcttgttgaattgtatttggatccattgttggatttgttgtttgttttaacaattcttctgcttgngttactgcattatcatatgctgtttgcttgtcagtatcagcatcgtgatagntctcgctacctttaatttgtgctttattcgcaataccttgtttcaattgtgtcatcgcgtcattaagcgttgttgccgcttgttgaatagcattgacgtttggtacaagtgttgcttgcgtgatttgtttgctgtattcatcacgttgcgcttggtttaagtttggcaattgatcaatagcatgttgaacattttgtttcgccgttgctaagtttgtattaccatttaaatcatttttagcttgcgtaactnnatctaacgctgcaggaatttcgctaggtgtaacgacaacatcaggcgtaccactaattaatgcttcagctttcgctactgcttgattatatgcatttttcttgtcagaatctgcattgacaaagttaccatcagcttttgtttgttctttatctgcaatgccttgttttaattgtgtcatcgcattgtntaactcttgcgccgtttgtttaacattgtttacaccagctacagtagttgcatttcgtacttgttgttttaatgcatctttctgtgcttggttaagatcattagagttattaattaatgctgttgcttcgtcttntgcatgttgaacgttggcattaccatttaatgcttgttntgctgcatttacttgttggattgcttgnncaacttcagtttgtgttgcattaccaccattagcttgtggaaatgatatttncagcatttgtaactgcagtgttatatgcttgttgttgngcttgatctnnatcagngaagttacctgntgctngcgtagcatctatatcacctatcgcttgtcacaagttacccatcgcagtatttaagttttgcgcattttgcttaatttgatttgcttcatcaccagtatgcgcgccattaatttgattagtaacagcttgtttttgcgcattatttaagntgtctaatgaacctaaagattgcgttgctagttgcttcgctgcctctaagttttcattaccatttaaagcatttttagacgtgcttacttgtccagcagcttgattgataacagtcggatctaatgaagggtttgtagtttgatcaataataccttgtgcagttgtgacagcattattgtacgcatcctttttattcggacttgcatcagtataattttggttttgttttgttgtcgcattatctgcaatactttgacgtaatttgtccattgctgcatcaacattgtttgctttttgttcattaccttgtgcttctgcaacagtagtcgattgttgtaccaattgttttaatgcctctttttgtgcatttgttaaatggcttaaaccgtcaattgctgtatttgcgtgttgtttcgctttttcaaggttttgagtaccattaagcgctgcttttgtagtattcacttgattcatagctgcttcaacttgatctttaggcacgttcgtacctgtagatttatttaaaatattttcagcattacgaaccgcttcattgtatgcattttncttctctggatcttgcatcttgcaaagtnnnggactggcaagtgtagtgtctttatcattcaagctatttttcaagttanccatcgctgtttcaaaatcctgagngggnttgattggttggngttnacttcanctacag

SEQ ID NO: 205 - DNA (Genomic DNA), 761 bp; single-stranded, linear
aaaatacaagcgtctaaatattaacaatctncctgtgacgctatatggcatatcttgctttttaagcatctgttgtatctctgccatcgagcgcattggccagcttcacaataattataatgaattgtttttatcgatggagacactaattgtgtcattgggtcaccaccanaaccatatatttgatgtggtttcataacatcatttttatcagaataatatttataggcagctaatgcaatcgtatcagttgctccaacanccgcatctacttgctccacattttccaaaacatttgcaacatctttttgtgcttccacataagtaaaatttgtttcatgtatattaggtttaatttggtatttagctaactggtccaagtaaacccacgttttctatgaataccacctgcaatatctttttcacttacactaaacacttcaacttgttgatatccctgttgaccaatccattcgcctataatttgacctgctttataatcatcatgcacaatactatgaagttgttcatgttgttgaccaacaataacgattggtacattcattttattaatgacttcaatatgtctctctgttatgtctgtagccattaaaacaataccatctactttactgcgtgctaatgtttcaagcgcttgtatttctgcttcgatatttaaacctgtgtaatttaaaattaattgtgattcatatttttggcattgttttgccaatcctttgattgtttcatctactgcatat

SEQ ID NO: 206 - DNA (Genomic DNA), 2334 bp; single-stranded, linear
ccacccanctgattataatgttttagcangagctagacttggttggttaccatcatatccacaatttaataaaaatagtttgttgtttgcagaagaagctaaagatgaaggcattgagtcgaatgaggcaattttaaaacgagcgataaatggaagttaagtcaaaacaaacgcaatttgcgatagaagatccggatttgaaaaagaatcatccggaaatcactgtttatatggcgctcaaatctaatctcaagttctgcaaaaggtcaagaatactttatgaagcatttacttggcacaaaatcagggttattagctacaccaaatgaagatgaaaagccagaagaaattacgtggcgtgaggaaacaacagggaaattagatttagtcgtttctttagatttcagaatgacagcaacacctttatattctgacattgttttgccagcagcgacttggtatgagaagcatgatttgtcatctacagatatgcatccatatgtacatccttttaatccagctattgatccattatgggaatcgcgttcagactgggatatttataaaacgttggcaaaagcattttcagaaatggcaaaagactatttacctggaacgtttaaagatgttgtgacaactccacttagtcatgatacaaagcaagaaatttcaacaccatacggcgtagtgaaagattggtcgaagggtgaaattgaagcggtacctggacgtacaatgcctaactttgcaattgtagaacgcgactacactaaaatttacgacaaatatgtcacgcttggtcctgtacttgaaaaagggaaagttggagcacatggtgtaagtttcggtgtcagtgaacaatatgaagaattaaaaagtatgttaggtacgtggagtgatacaaatgatgattctgtgagagcgaatcgtccgcgtattgatacagcacgtaatgtagcagatgcaatactaagtatttcatctgctacgaatggtaaattatcacaaaaatcatatgaagatcttgaagaacaaactggaatgccgttaaaagatatttctagcgaacgtgctgctgagaaaattcgtttttaaatataacttcacaaccacgagaagtaataccgacagcagtattcccaggttcaaataaacaaggtcgacgatattcaccatttacaacgaatatagaacgtctagtaccttttagaacattaacaggacgtcaaagttattatgtggatcacgaagttttccaacaatttggggagagcttaccagtatataaaccgacattgccgccaatggtatttgggaatagagataagaaaattaanggtggtacagatgctttggtactgcgttatttaacgcctcatgganaatggaatatacactcaatgtatcaagataataagcatatgttgacactatttagaggtgtccaccggtttggatatcanatgaagatgctgnaaaacacgatatccaagataatgattggctagaagtgtatanccgtaatggtgttgtaacggcaagagcagttatttcgcatcgtatgcctaaaggtacaatgtttatgtatcatgcacaagataaacatattcaaacgcctgggtcagaaattacagatacacgtggtggttcacacaacgcgccgactagaatccatttgaaaccaacacaactagtcggaggatacgcacaaattagttatcactttaattattatggaccaattgggaaccaaagggatttatatgtagcagttagaaagatgaaggaggttaattggcttgaagattaaagcgcaagttgcgatggtattaaatttagataaatgcataggatgccatacgtgtagtgtgacatgtaaaaacacttggacaaatcgtccaggtgctgagtaacatgtggttcaataacgtagaaacgaagccaggtgtagggtatccgaaacgttgggaagaccaagaacactacaaaggtggttgggtactaaantcgtaaagggaaacttgaattaaaatctggaagtagaatttcacaaattgctttaggtaaaattttttataacccagatatnccattaataaaagattattatganccatgganctataattatgaacatttaacaactgcgaaatcagggaagcattcgccagttgctagagcgtattcagaaattacaggggataacattgaaattgaatggggacctaactgggaagatgacttagcaggtggtcatgttacaggcccaaaagatcctaacatacacaaaatagaagaagagattaaattccaatttgacgaaacttttatgag

SEQ ID NO: 207 - DNA (Genomic DNA), 2698 bp; single-stranded, linear
ggcacgagactaatacctgaaattaatccaccaccaccaatagcggcaaataaataatcaaagttaacggaattgtcagtctttgattgttctagcatttctttagcaagcgtaccttgtccagaaattgtatgaacattattgaatggatctataaagttcatttgatgttcacttgtataagttaaagcttcagctaaacagngatcaaatgtatcaccagtgagtacaacttcaacgttactatttccaaagaactttacttgatttaccttttgtnaaggtgtagtgactggcataaagataacagcgtttanattaagttttttagctgtataggcaacaccttgagcatgattacctgcactcgcacatgtaatacctttacttttagcttcatctgataaaacagaaatagcgttgtaagcacctcttaatttaaaagaacgtacccattgtaaatcttctcgttttaaataaactttacaatcatacttttgagataagtaatggtctaattgtaaaggtgtttctttgacaatatctttaagtcttaaaaatgcttcatcgatatcttncgtagaaactgntgttttgactggcataatattcaactcccttaaagtgatttnncatattnntctattaatgattcatattgtagggtgattgcaattgtcatctaagccatttaccaagtttatttttccaaagtttcatcaatttcaaaatggaaacgcttgtctggtgatgacacagtttgatttggtaaatctatttcaatttcctcatattgtgcaagatgttcacgagcacttttttctaaancgataggcaacatcgcatttttagtgcaattcatataaaatatgtcactgaaacttcctgcaataataatatgnaaaccatagtccttaagagcccaagcagcatgttcacgacttgaaccacatccaaaattatctccagtaattaaaatagaagcccctttatattgtggtttgttaggattgaaatcaggattatctgaaccatcaggtaagtaccgccattcatcaaaagcaaatggaccaaagccactttttgaaatacgctttaagtgtaccttaggaatgatttggtctgtatcgatattgtcgttgaagagagggactattttacctttatatgttgtaataggtttgattgctgccatttaaacaaccacctttcttacgtccacaaatttaccatgaatagctgctgctgctgccatagcaggggatactaaatgtgttcttgcacctttgccttgtcgtccttcaaagtttcgattacttgtagatgcacaatgtacgccctcaggtacttggtcaggattcatgcctaaacacattgaacatcctggttcacgccattcaaatcctgcatttttaaagatagtatctagacctaatttttctgcttctttttttactgtacgagaacctggtacgacaatagctgtaatatttggatgaactttatttcctttaacaatatgactagcttcaatcaaatctgatagtctagcatttgtacatgaaccgagaaaaacataccctaagtcgatgtcttcagctttttgacctggttctaaccccatataatcatacgcacgttgatcgttgatatcattgatttcagggaatggttcactgaaattaacacccatttcaggattagttccccatgtcacttgtggttctaatgttgaaacatcaagttcaattacacgatcaaatatcgcgtcgtgccatcagaatatagctcacgccacttatcaactgatttagcgaagttatcggcaaatggtctccctttaacatattcaaatgttatatcatcaggttggattatgccgtatttggcaccaccttcgatagccatgttacaaatagtcattcgaccgtccattgaaaggtttttaattgtttcgccagtaaattccaaagcatagcctgtaccaaaatcaacaccatacgttttaattaaatgcagaataatgtccttagcatagacgcctgttggtaaggtaccattaatatcgatttttaagtttttgggttttgtttgccatagcgtttgagttgcgaaaacatgttcaacttcacttgttccaattccaaatgcaatagcaccaaatgctccatgtgttgctgtgtgagagtcaccacaaacgattgttttgccgggctgtgtaagtcctgtctcaggtcctaccatgtgaacaataccttgttcatcagagcccatatcaaaaatatgcaccccaaaatctatggcgtttttttgtaatgttgtgatttgtttgtttgcaatttcatctttaatattgaaaatatcaatagtaggaacattgtgatcgagtgttgcaaatgttaaatctgggcgtcttaattttctgttttgaagcctaagtccttcaaatgcttgaggagaagtaacttcatgtataaggtgtaaatcaatgtataatagttgcgggtcgcccnatttcccgnataacacatgtctgttccacaccttgtcaaataatgtttgacccagttacatctccccctnagtgattcaatttttgagatagcatttcgaaaatatcagtagtattcaatttgccgcctaaatctgctgtcgtttgcccatgttcaatcatgttataaatatgttgttctaattc

SEQ ID NO: 208 - DNA (Genomic DNA), 706 bp; single-stranded, linear
ctaagangatantttaagcttgtaacccaacagttcgcaggttaaatccaatccagtttgaccaaagaaataccgacccaaaccgcctttgnaccgtagttggataattaatggggaccgcccaaagataataagcagttagccgnnnaggttccgggaataggnccgtttaaattnaaaacccagctgccttttgcttcttgaaatacattggggaatctggattagatggtccgaaactaccgtcgacaccatcacgtcaagcagttgcaatnccagcatcagatgtgattataaacaaagtgatgacgagtgatacacctgtaacaattgtagcgacaggtcctcttacgaatgtagcaacggcattgattcgtgatccaagaatcgctgagcatattgaatctattactttgatgggtggtggtacatttggaaattggaccgcctacagcagaattctatcaatacctacttctttcttgactaaatcanactgtggcttcgttaacatgccacttggtgtgatataaaaactatttttaaagtaatagcttacagagtggttcaaatgttcagcgaataaagcttcatccatacgttctaagaagaatgggataaactcaccccaatgtccaataatcatatttaactttggataacgatcaanaatgccagataatactagatgtattgcatrrdctns

SEQ ID NO: 209 - DNA (Genomic DNA), 634 bp; single-stranded, linear
cttgttggatcagatccaacactacctgatggatcnctatcnagattgagcacgccaccatatcagatggaatatcaaccttgtcatgggacagactgacacctgaatganggggtgtctggncanncacatcatcaccattaatgggacagcgagtggcacatntccatgtagtaaatggcacttattacttacacggncatatcgtgncaggttggcaaggtgtgaaaaagacatgtgatacagcggaagagcttgacacatatataaagcanagtgatgtggtatatgaggaacagaagcatctanctttattttaagngggcggaaacaatgaaactcaangttaaaagaganatgagattagatgaattaattaantgggcgagagaaaatccggatctatcacanggaaaaatatttttcncaacaaggatttagtgatggattccgtccgntttcatccanatacaaataagtgtctcgacgncaagttttattccaattgatatccccttcatagttgatattgaaaaagaagtaacggaagagactaaggttgataggttgattgaattattcgagattcaagaaggagactataactctacactatatgagaacacgrrdctns

SEQ ID NO: 210 - DNA (Genomic DNA), 1157 bp; single-stranded, linear
ggcacgagcgcccatttaattaattcatctaatctcatttcttttttaactttgattttcattgttatatctcctcttgaacagtaaatttatcgttaattgatacgtatccagtcacattacataagatgctatcaacatcaaaagtcacacaacagttgcgttcaacatcatttgaatagaatcttttattacctgataacttggcggttatcaccaagcccattgaataaattcagctaaatctcatttctttttcaactttgattttcattgtttccgcccttttaaaataaagttagttgcttctgttcctcatattccagaatcactttgctttatatatgtttcaagctcttccgctgtatcaaatgtctttttcacaccttgccaacctggcacgatatgaccgtgaaagtaataagtgccatttactacatggatatgtgccactcgttcgttatcctgatacagatatctcttagagccgaaaaaatgttttaagtattctttacgtccgctatctgtcatggtcatcactcccgcaagtcaaatactctatcgacgtaaaacttcgcctttgctaaatcctcatgaccattctttaacggtgctctagacaagtatttaattgcattacctattgcgaatgctaattgtggtgggtactgtgccgtaacttgttcaataaaatctataatttcaatgttcgccgtatgttgttaatgcgcaggttgcttaacgttgtcttgcgttttgttcatatctacttttctgttactgattatgctcattatgtttcactccatttcttgaacatttggttatagttgacatcgaaccagtacgatcacgttgaatgtttttgagtacatcaaataatgttgctccttctctagctcagcttctttacgtcgtagcctagccatttcacgctctcgctccaaagcttttgttatttgtatttctctatagtcgtttagcttcatgccgaaaggtgcatcaattgcttccgacatctcccaacccttcgcaactctgtttctaactatttcgggcgtgagtcctttctttttcatctgctcattttcatattcagtgtatttagaagggggtttttcttgtggtggcgcaataagcgcatcgcccgttagccc

SEQ ID NO: 211 - DNA (Genomic DNA), 725 bp; single-stranded, linear
ggcacgagctcgtgccgattcggcacgagcttcggctgtattggtacctatcaatacagacattgccgctttttctaaatcttcaatactaccttgagtcacccgccgtgtccaaccgttctaaataagccttttgttgcaggtgcttgncaatatctttgnacaagctatcaacgttatttgtgccaataacttgtcttgctaatttttgcantaaanacgattcttcattcgtcgctttagaagaagaaatgaatgatagtgcatctgggccatacttttctttaatagatgtaaaattatctgcaatgacatttaaagcttcatcccattctacttcatggaactcaccatttttccttactagtggtttagttaagcgttgatctgaattaatatgtccccatgaaaacttacctttaacacaagtcgcaattttatttgctggagaatcatgtgatggttgtacttttaaaatttctctatctttagtccaaacttcaaatgaacaacccacaccacaataagtacacactgttttagttttcttaatacgctcttaacgcagttctgcttctgaatctgagattgcaaatagtggaccataaccaggttctgcttttttagttaaatcaatcattgctgctaatgaaccaggttccgtatcagtcatataacccgcattaccttccagattcacttccatcatggcattacatggacag

SEQ ID NO: 212 - DNA (Genomic DNA), 1676 bp; single-stranded, linear
aaaatccaaggcacaaagttctaaatacggagtcaaaagaatattgaacaagcacattttcaacaatactttgaaaatttattatttcataagttcatcattgatccaaagtaatattgcccttgccgatgttcatcttattgactatttatttacagccattagttagatatatttttgagcgaattgtcatggctgtgattgtcatcattggtgttattgtcagtgtgtttaccattctgtatttttcaccgcttgatgcggcttatagcatactgggacacaatgcaacanaggcacagatacatcaattcaatgtattacatcatcttaacgaaccttattttattcaattgtgggataccatcaagggtgtttttacctttgacttaggtacgacttacaaagggaatgaggttgtgactaaagcagttggcgaaagaattccaattacaataattgtcgcagtattagcgctaattgtggcattaattattgcaataccaattggtattatcagtgcgatgaagcgaaatagttggcttgatatcacgttaatgataattgcattaattggtttatctattccaagtttctggcaagggctattattcattttagcgntctcattgaaattggatattttgccaccatcttatatgccagaacatccaatatcggtggattttacctgtacttgtcattggaacaagtattgctgcttctatcacgcgtattgacaaggtcttcttgtacttgaaggtaatgcgcagcgattatgttttnactgcttatgcaaaaggattatcgacgacacaagttggttattaaacatattgtggaaaaatgccattattccaattgtacggtaagtgggtcttcctnggtggcagagttactaggcggttcagcagtgacggaacaagtatttaacattaatggtatcggtcgttatatcgtccaaaaacaactaatacctgatatcccagcagtcatgggtggggtcgtatatatatatcaattgtaatatctttagcaaacttaattattgatatattttatgctttaatcgatccaaaattacgtagtgaaattaacgaaaggaagtgaggcatatggtaaaacttacaacaaagatagcttccttaaaactattcgcaagttatgctatagcaacttatattttagttatgttaacgagtgcattaaatctttttaaaggttatgtggccgatacgttctatattgctgaaacattgctaatcattttaaccatcattttaattatcattttaacaacggaacaaacatggaagcatcatgacctatggcgacgtatcgtcgaagtgttgttattgttgatggcattaacaggcaacgtatttacattattaatgtgtgtaagtattagacgttaccaacgtacatcgcaaatacatagttataacggggtgggaatccgnttatacgaaaaactactagacatccgtatttgcgattatcggggttacttattttagtctacatgctgacattatcaatngtgtcacaatttaaatttgatacgacaatggcttactaaaaatccagtccaatgaactngtacaatggaccgagtctagcctatccgtttggtactgatgatttcggtagagacttatttacacgctcgtgcc

SEQ ID NO: 213 - DNA (Genomic DNA), 1978 bp; single-stranded, linear
ctaatcgtatgaacgagtacccagaggtttgaaatttaatattgattctatnaatgattccttagtgtcgcataacggtgcaagagcacgatacttaggatcaataaaaccttcgtcaatcatatggtcaatcattgnttgtagtggnttgaaaangccattaatattataaatggcaataggcttgtcatggatacctatttgagcccaactaatacatttcgaaaaattcttctagtgaaccctgcgccaccaggagccatgacaaatgcatctgcaagttctgccattttatttttacgttcatgcatagaatccaactaaaattaattcagttaaacgttggcttgtgatttcatgttcatctaacattttaggcatgacgccaatagctttgccgccatgatttaatacaccatcttgaatggcacccataatgccaattgaccctgcaccaaatactaattcataaccttgttcagcaaaatatttacctaaatcgtatgctttttgtacatatgaagggtcatgacctttgcttgcaccacaataaactgcgattcgtttcatgttaatccagctccttaattcgatgaatgacttttaatagtgattgttcaaacactttttgatcttgctttgtaaaaggtgggggacctttgtggcgaccaccttgttttctaatttgtgcattcatatatcgtttatctaatagttgttgaatatttttggaattgtatatcttcccattatgatgcatgacaattaagactttgtcgactaataaacttgcgagtccataatcttgagtgactacgatatcatccttcgttgataattgaacaattttgtaatcaactgcatctggtccatcatcaacatataatgttgatacatgtggaggatataattggttcgaaaaatggctgaagctccgaataattgtcacaaaaatgcctgtctcagttgttaaatctataatagaatcnacaacaggacaagcatctccatcaataataatatgtgtcacaattatgcctctgtattgttttctttattttgttgagaggcgcttttggcaacataatctttatattttttaaatgacttgatgcgtgctttatcagcttcttgttggcgtttgttcttctttgtgtcgtttttcaatatttttttgtaactttttattcattttagcgatttctttgcgatttttttcagctagtttatcgccttttctctcagttttctcatctaatttattaggtgttaagcctgctttttcttcgtatttttgtgattttttcatatctttaatacgttgtatttcattcttttcgcgggctttttgctcttctttatgacgcttttcgatatttttttgaagtattttattcattttatcagcgtctttacgattttgtttagctaatttttcgccttttttctcaatataggcaggatcatgttctctagcaaactttttaagttcacgtttattttcaaaatcttgttttttatcgccgacatattctttaacatcactcgctgtgttactgattgctgcagatgtttttgaagcaactttacttggtagcatctgtaacttttgggacgtccggatgttgtttgatacgtttacgttcaacaattaacggtaccaatacaattggtaatacattaatcataaatttgatgacttttttcttatccatagatcttgcctccataattactttattaattttacataccctatgatacatcaatataaacgatgatagtagtgantcactattaagtatttcagatgttttttanaagaagacaataaaaactgccaatcacgtggttccttaattgacagtctatattttanacaggaaattaaatacctttaccaatgccaatccgaagtaaagtatagcaatanagattactaatacanttctgctaaatggcanatggaattagtctg

SEQ ID NO: 214 - DNA (Genomic DNA), 2558 bp; single-stranded, linear
ggcacgagcgatgtgcccagcttttttcaattgcaataccatcggtccttgatattgttcttctggtacgtctttaagtcctaatgttaattccacttcttttgcatcatctgaccataattttctgaaatctgtttctactaaatcttcttgatatacattttctggtaatggtggtaaccatggacgcttaacttcttcaatttctaatcgtgttgtaatagattcgatatgatcgataaccgcttctaactcggtttggttttctttcgtttcttcatcttcaagtccactcaagtctttgttgattgcttgaagttgaccatagtcattaatcatgtaaatcgtcttatcttcaacttctaatttatcgccttcgatgtcatatgttgcaccactccatgcagattggaataattcataaatttcattattaccaactttgtaaatacgcacgacctggtaatgtaatgtctgctgcatctggtgtttttaaaatttcattactgtcttgtctatctggnacgagttntaatgccaatttaaattnagagttagaccaaatttggtcatcaacaacacccgatggtttntgtgtcgcaagtattaaatgaatacctaacgaacgtccaatacgtgncggngatacaagttctntncacataaaatcaggttgntctgattttaattcggcaaactcatcggaaataatgaataaatgtggcattggctctgntgcaacaccttctttaaataacttatggtattgattaatatggttaacatcatgctctccgaataaacgttgacgtttctcaattcggctttgattgatgttaaggcacgcatcgcttcatcgccatctaagtttgtaatccgtaccaactaaatggactaaatctttaaataagttcgccatacccccacctttatagtcaatcaataggaacgcaacttcatgtggatgaaaattaatagctaaagataaaatgtatgattggataatctcaagatttccctgaaccagtggtaccagcaactaaaccatgtggcccgtgtgctttttcatgtaagttcaatgataaaatatcatctttacctcttacacctaaaggtactgccatcgttttgtatgtttcgttttgtctccatcgattaaccacatcaagctgatctacttctttcacgttatacatctctaaaaatgtaatactatcaggaattgcatttttcaaatgttcgacgtgtatcaaattcgccaaacgtctcgcgatgatattctttatcaacgttatcaatattttcaggtgtaaatttcaattgaactaattctttttctttcgtaatcagttcgccttcagtacgagacttgatatcaataatggtatctacatgctctggcaaactttcaatcacatcttcaacaaagattaatgaaataccatattctgatnaatcttggntnacatagtctaaaatgacatgatcaataattaatgacatatctgtaatgacaaacactaattgcggtgtgaaaataatttgctcattacttctgctgcgttcacgcacagcttggatacgttctttaatcatgctataaattgacgttaaaatttggtcacgtgttcggtgattgtaaacaaaccctctaatgttttgacctctcaatgtcatatgtggcaaccaacgtgcccatttcaatgtttcaacttcatcttcacgtgtcacaaatagaaactctaaatcatgataactatggaacgttgacaattggattagcattttctccaattcttctaaaatgagatgtcgggcaccaatatatgcaattggtccatgatttaaatcattgattaatgggtgctttgtccnacanctntganaaattcatacaattctttagcatcgtcgaatagttcatcacgacgttggttaaattctccntcttggtaatctaatttgaatgacttttctacattcgcaatacctaacttataatgtaagaaatcgtgatgatgcgatgttttttcatatattcttggtgctttcgtttcaacgatatctttaatttcancaaccgttggataatggtaattcaaactaaaacgttgtgctttaatcgctttattaatttctttagatttattatccaaataagctttgtaatctttctctcgtttttcaacatctttgttatactttttcttttcagagaaatacgttgtaataccaaatactatcgttactgtactcataccaatcatcattaaaatataaataccaattggtctcactaaaaagatgacaacagttaaagcaatcattactaatggcggtataatggaacgccatatcactgtattccggaattccggaattccgtattggctgtggcggtctttcaatcttaatatcatcggtcgggtcncggtgnataatccttggcgagcgatggtacgtattgtaatcatctgcctgtgcatgtggcatctcttgtgttaagcgaattaatgacgatgccactgtattctgactcaatacanttaaaccatcag

SEQ ID NO: 215 - DNA (Genomic DNA), 668 bp; single-stranded, linear
ccggctgattattagcgaagcgagattttgaagagatgcaaccattatatgaatggttaggtttaactgcttcattaggttttgttgatattgtggattatgagtatcaaaaagggaaaaacgtaatatatatgaacatgatattataaatacaactaatggacgtctcggttttgattatttaattgataatttggctgatagtgcggaagggaaatttttaccacaattaaattacggtattattgatgaagtggattcaatcattttagatgctgctcaaacaccattagttatttcgggtgcaccaagattacaatcaaatctatttcatattgtgaaagagtttgtagatacattgattgaagacgtgcattttaaaatgaagaagaccaaaaaagaaatatggctgttaaatcaaggtattgaagcggcacaatcatactttaatgttgnagatttatatagcgaacaagcgatggtcctagtgcgtaatattaatttagcactgcgctcgtgccgaatgttccttggttcatataagtcatatcgatgtaaaaatgttcttaaatttgggtgcatgattggagaacaaccaggtggataatcttagtcattttcaagggtgcattcccattaaacttatcatatcggcaaattcccgcttt

SEQ ID NO: 216 - DNA (Genomic DNA), 2606 bp; single-stranded, linear
cccaaatcctttgaaataaaacttaattaagttcaagaantcgnggtgattttccccggaagtttgtttgaatattattatggattgatttgatagagcttatggaccccacattaatattgaagtcctggggccaagttcacncccccgtgggtggaatttcctatttgatccctaaacccaaactatggacgtcccaaattctaaatatgaaaaaatggctgagcatcgtttgatgaatcatgatttatatcccgaaaaaatagataatcgttaaatgtatcatttaataaacacaccaataagttgattttcctaacttattggtgtgtgtttttcatttagcatacataataggttacattaaaataacattttatacccaaagtacaccaaaagaatattagtacacgaattanacaacatttttatagaaacctattgcactttaacgtcaataagtatatttttatattatctctaattaattgtgcgcgcttaataacagaatattctcaatatttttatttttttgtgatttgttggaatatttagttgataaggcacaatcaaatttacttaaactattgtattaggggaagaaaggatgggatgtatacatgacacaacaaaactcccatggaaatcaaattcaagacatacctcaaacaggatttttcgggcatcctcgaggactaggcgtactcttctttgtagagttctgggaaaggtttagttattatggcatgcgtgccctactcattttctacatgtactttgccgtaacagataatggccttggaattgataaaacaacagctatgtcaattatgtcagtttatggttcattaatctatatgacatccaataccaggcggaatggattgctgacagaattacaggcactagaagcgctactttattaggtgcagtctttattattatccgacatatttgtttaagcttaccatttgcattaatccgcttattcacatcaatgttctncatcattattggctcaggtttaatgaagccaaacattccaaatatcggtggccgtttatatcctgaaaatgatagacgtatggatgcaggttgtgttattttctatatgtcagttaatatgggtgcattattatcacctattattgtgcaacactgtgttaatgttaaaaacttccacggcggattcttgattgcagcagttggtatggcattaggtttagtatggtatgtacttnacanccgcaaaaacttaggtagcggtggtattgaaaccnactaacccattgacnaccagcttgnaaagaaaaagtatggtctttattatcggaagtggtgtctttagcaantgtattaattatcggtattggggcattaactaactcaatatcaantaacttaggtaggaatactgttttagtattaggtattgcattaccantcatttacttcactttaattattagaagtanagatgtcanngatactgnacgttctcgtgttaaagcatttattccattatttattcttggaatggtgttctgggctattcaagaacaagggtctaatgtattaaacatatatggaantgnacattcagatatgaaattaaacttatttggttggaaaacanactttggtgaagcgatcttccaatcaattaacccattatttattttattattagctccaattatttcacttttatggcaaaagcntggaactaaacaacctagcctgccagtaaaatttgcaattggtacgttcttagcaggtgcgtcatacatactaattggtattgtaggttatgcatcaggttcatcaaacttctcagttaactgggttattttatcgtacattatttgtgttatcggtgagctatgcttatcaccaacgggtaatagtgctgctgttaagttagcacctaaagcatttaatgcccaaatgatgagtatttggtacttaactaacgcttctgcacaagcaatcaatggtactttagttaagttaatagaaccactaggtcaaacaaattactttattttcctaggtgttgttgcaattattgttacaacaatttgtattagcattctcacctttaatcatcaaagcgatgaaaggtatacgttaatattgttggcctaattcaaaaaacagtaagtcatttaaatggcttactgtgtttttataggtttctattaattaaattcaagatatcagtataaataaaagcttaatatgctcgttatagacagctataactatattttctcgtcccactctatagacatcaatgtcagttattaccattttctctatttaaaaacatatttttggtattaacaattaaaagtgggtatatatatttaatgaaccaatttttagaaagtaggctaaactatggaaaataaatatacacatggtgtcctcttttaccatgaacacagtggattaaaaaatattaatcaaggtattggggaagttacaacagcattaagttcaatttgtaagcatctttctattcaattgagtgaaaacgaaggtgacattattaaatattgccaagaaatcaaaactaaaaactatccaaaagatgtagatag

SEQ ID NO: 217 - DNA (Genomic DNA), 367 bp; single-stranded, linear
ctacgatggcatctaaatctgcggtgtcgtcaataatcagtgctattgnctggtggncctgcnatgtgagcaatacgctacctgtccaaataaanattttgnggnagatgcaacaaattgggtacctggaccnacaatcttatcaactttaggtatcgtntctgcnccataagtcaatgnagcaatactntgagcaccaccnnctnganacacttgagtancttgcgtaagataacatgcagctaatacctcttgggatactccgttagggtgaggtggtgtcacancancaatattttctacacccgctacttgtgctaaagtacnctgtcattaganccgttgatggataacttgctttgccacg

SEQ ID NO: 218 - DNA (Genomic DNA), 1485 bp; single-stranded, linear
ggcacgagcgatatttgtcaggaagttaaagttcatggagataaggctttgaaaatgtataatctaacattcgatcatacgaaaacagatcatttagaaattagtcatgaacaaattaaagcagcatttgacacattagatgaaaaaacaaaacaagcattacaacaaagttatgaaagaattaaagcatatcaagaaagtattaagcagacgaatcaacagttagaagaatcagtggagtgttatgaaatataccatccactagaaagtgtgggtatttatgtgcctggtggcaaagcaagttatccatcaacggttctaatgacagcgactttagcacaagtagcgggtgtagaaaatattgttgttgtgacaccacctcaacctaacggagtatcccaagagggtattagctgcatgttatattacgcaagttaatcaagtgtttcaagttggtggtgctcaaagtattgctgcattgacttatggaacagaaacgatacctaaagttgataagattgtaggtccaggtaaccaatttggtngcatatgcccaaaaaatatttatttggacaggtaggtattgttccanattgcaggaccancagaaatagcacttgattattgacgacaccgccagatgtagatgccancgnctntnatgtttttgggcaagcnagaacatnatgaattagnacgtccatntntcattggtgaagatgcgcaagtcctnaaagatttngaatcacntattgctaangcattgcctaatgtggacaganacgacattgtttctanaagtatcgcnaatcaacacnacctnatccannatngtaattnngatntgggngaagcatcnccanctcatgaatacaatcgcgcctgaacatgcgtcgattcaaacagtaaatcctcaaccaggaattcttgttgaacgaataatttctatctcgttatcatcgtaagcgtcattatcaacttgtgtttcttgcatttcttgtaattcggcaacaaacacttcttgatctcctcgatcacggctcttacgattaatacgtgttttatattttcgaacttgtctttcaagtttattattaattaaatcaatacctgcgtataaatcatcgtttcgctcttcagctcttaacgtaacatttttcaatggaattgttacttcaattttagtagctgaatntgaataagttttaactttaacatgcgccactgcatntggtacgtcattaaaataacgttccaacttaccaatttnctcctcaaatatagntgcgaatagcatcttgtgataggggagggntatctccaatgaatttncaaatctatatcatangggaatctctcccttaaacctctttattggtaactctttattatattnnnacattnnnacgctatcgngcaaacgcaaacactttggattctctgatattntnnagcatattaatttacaaccctgcacgatgattg

SEQ ID NO: 219 - DNA (Genomic DNA), 1514 bp; single-stranded, linear
atgatgtaaacccagttccnancttcatcattcagttgatgcaataatgtcacnnaaactctaccaccaagatgcaccaataggttgtccctaaatgcaataagcgccaccctttaacaattcacccttttcagggaggtnattttaaattcaccgatccaacagctaatgattgtcctncaaatgcttcaatttaattccaaatacatcaatatcgcttaattcttttttactacgtttccaaagccttttctacagcgccaactggtgcaatacccataatagaaggatctacgccatgacttcccaaagccatccaagcactgccaatggttcgatatttaattctttagctttgtcttctgacatgactaacatcatcgcagcaccatcattgattcctgatgcattacctnctgtaactgtcccgtcttttttgaaagctggtcttaagcgacttaatttttcgactgatacattttcacggacaccttcatccttagtgactaagattggttcacctttacgttgaggaatcgatactggaactatttcactatcaaattcaccattttgctgtgcacgtactgctttattgttgtgagattaccagcaacatgtatctttgttcttctcttgaaataccatattgctcctactaaattttcagcagtaatacccatatgatattgagtaaatacatctgttaaaccatcatataccatgctatcaaccattgagtgatgtcccattttaaaaccgaagcgactgttgttgncaagcattggtgnctgagacatattctccataccgccagcgagcacgatgctcatgcccaccagtcagcnatagattgatatgctaattgantcgactttaacccagagcccacatactttattcactgtaaatgcaggtgctgtttctggcaagccacctttcatagcagcaattcgtgctggattttgtccttgtcctgcttgtagtacgttaccgatgataacttcatcaatctcacttggattcaaacccgtctctttaataatatgttctattaaagtcgcacctaaatcataggctggcacgtctttaaacgcacctccaaaaacgccaataggtgtcctgtatgctgctgctaatacgactctcgtcatgtcatattcatctccttatgatatatacaattttattactaatacgtctaatgaaccaatacgccactaacatccaatttatgaaaccaattgctacgtatgttacattttcattcttgttatgcatttaacaaatcatattatacaatgatgtaatttgtttgggcaatcggaaacgtaaacggtttcactttaacatttcacactcttaaatatgctctatcatcctcatctatagtacaaaattatgctttgatttaccacaaattatcattaatcatttcgctcgtgcctctaattaaattctttctatcattggatcgntatcacaggtggnttcaccacaattctcatcaattt

SEQ ID NO: 220 - DNA (Genomic DNA), 1000 bp; single-stranded, linear
ggcacgagctcaagtaaagtgctaccatttttcttacagacatttgccganatcttaaactaagacatancccctaaaatactcnctanagnaccgnacaaccncaacacaattcctgtcatgatcttaggctttgtgccacctnccccagttgncaaatgctttgtccatccttcttgtaatgactgaaatccttcttgatacatncgaaatgcaacaaatggaaatccttcataaactgttacgggcaatgattgtgaagtagatgcacttcctaaagcaaatccttcaataaaaatgacgggtcgcacttttatgacctccagttgcataataatcttctttatttgttaatgtcaccggtccaaatgcatgctggttagtccgcaccgtcgtctaaggtanaaaatacattcataccaccgacttgtcattaaattaaatatcgctgaaaacccttcgtagaaacgctttgttatatgataaggctgtacgcttaacaatcctttttcaccttgtaattgatactgattaatcaacgtttcaacagcatctttccttaagaaagttacatcagcatctacaaaggcaatacgattcgtacatgcatgcgtcacaccttgataacaagcatgtgatttccccataccatttgccgtcagtatcatcaacaacatctactacagtcgcaccatatgaacgtgctacacgtgctgtttcatctgtcgatccgtcattcataacaatgacatctactggaacttgctgttgtattatcgaatgtagtaaatgacctattcttttttcttcatttctagccggaataataattgttaatgctttatgattgaagttcagcgttttcgtctttagctgatgtctacgattaaatatcaatgcaccacacgccatagacatggtcactattactgttaatattcgtgataaccatttcatagatatcacttcctattcttcgcttctcgcgcgagcccgngcc

SEQ ID NO: 221 - DNA (Genomic DNA), 1047 bp; single-stranded, linear
ggcacgagctatatccaattggggtaaagcgggtaaagaccaagagaagaatttaagaagacattagcagaaattgaaaggacaccggcacgagctagcgcaacaagtttagcgattgaagcatttggtgcaaaagcaggtcctgatttagcagatgctattaaaggcggtcgctttagttaccaagagttcttaaaaactatcgaagattcgcaaggaacggtcaatcagacatttaaagattctgaaagtggctccgaaagatttaaagtagcaatgaataaacttaaattagtaggtgctgatgtatgggcttctattgaaagtgcgtttgctccagtcatggaagaattaatcaaaaagctatctgtagcagttgattggttttcaagtttaagtgatggatttaaaaggtcgattgttatattcggtggtattgctgctgcaattggccctgtagtttttgggattaggtgcattcataagcacaattggcaacgcagtaactgttttagctccattattagctagtattgtaaaggctggcggattgattagttttttatcaactaaagtgcctattttaggaacagtcttcacagcattaactggtccaattggtatcgtgttaggtgtactggctggtttagcagtcgcatttacaatagcttataagaaatctgaaacattcagaaattgtgttaatggtgcaattaacagtgttaaacaaacgtttagtaatttcattcaatttatccaaccttacattgattccgttaaaaacgtctttaaacaagcggtttcagcaatcggtgatttcgctaaagatatttggagtcaaattaatggattctttaatgaaaacggaatctctattgcacaagcgcttcaaaatatatgcaattttatcaaagctatatttgaatttatcttaaaattttgtaattaaaccaatcatgtgtgcgatttggcaagtgatgcaatttatttggccggcggctaaagccttgatcgtcaagtacttgggagaatataaaagagtaatac

SEQ ID NO: 222 - DNA (Genomic DNA), 1526 bp; single-stranded, linear
ggcacgagcggtacgagttcactgttaatctgcacttcaatgtgattatgatctgagttatcctgcatttcgtaaccgatagcgatgtttgttactttttcaaaattaatatcactattgttcgctaagcttgaacgtacagactctaatttcggcaacgttttattatcctcactatttaacacaacgtcggtgcgcaataacgaacgacgataatcaaagacgcctttttcaccccaagtgacttgaatttgattagagccttctttattaaacgttggataaccgttaaggaaacgttgatatgttaactcgcctgactgatggcattcgtactaaacaatctgaagtcttcgtttaagaaaccaccatgaccattaataaaatcaaaggttcctggaatcgtttcttccattgtgctggaacttgcttcatcttcggacaggtttttataatgatatttcncatttttatcgttatagtgtgngacacctgtattattgntgtaggttgtaacaccactctntganctacgaacgatggntgantcgacaaatagtatagcatncattttctcaacactaatcgtgttaaataccatgcgatatgtttttancttnncaggtttaccttgggtgcaaaaacatgcgtcgnacgatcaattgtatctntgtgtgtgatgatatcttgtgtatgggttgcatatcttttcacactgctgcttaatgcatcttaaaaaatgnatcatttcgcggtggtagntgnttaattttacggtaatcggggcggtctttacttatagcataaagcacgatattatcatcagcatcatgatctatgactaaacgattgaaattgaaatgatttggtactttcgcattcaatgttcangaacttggccaagatatgttgataacggtaaatcaaacgtaaaatcgaataatgtaaaatcactgcttaaatccggaatcatcaagttatgatcacgacgaacatgttccacggacntcacttctttatttttcaaaggtttcgtcagtttattcacattagataccgtcgcaatcgtaccttctggatgatcatttttcgaatgaataatctgaaatggcgtaatagttgtatccattttggctgtcataggtgtcgttaaaggtttcgtttcactcttcttactatctgtattgtcgacatttgcaatatcaggagaaaagttccataccatatatgtcaatacgacactcatcaagacgagtagcgctaaaatgacagatttaatatgttccttattattcatcccaatcaccgtcttcaatgacttcacatggaagtgtgataaagatagatgtaccttgaccttctacactgtttgcccaaatacgaccattgtgcgcttccacaatctctttcgaaatggctagtcctaatccagtaccacccattttacgctcgtgccgtnccttatctacacgatagaatcgggncggaatatctttatcgactttattggataggaattcccgatg

SEQ ID NO: 223 - DNA (Genomic DNA), 1421 bp; single-stranded, linear
ggcacgagcgagcaatatcaaataataaatcatcatcaatagttcttccttggaaacgttcagggatgatgttgaataataatgacgtatctaatatatggtcatataaagagaaatcaccaactgggatgctatctaagtgatagtacttttgtaataataaattttctttatgtagatcaggnaatgnatgcatctancnactcntcnttaganntcntcnttgcccaanaactttcgatggcttttctccattccctttctcnacctaatcttgggaancctaagtttgatgttttaattgttgacataatattgcctccttgtgagcaggtaatagatttngagtatgctgcaagttctaatgaatcttcgacatttnganacggtgtgataatgtataaaccatnaaaatattcatgaacagtatcgattaaatcctttgaaagcttaagacttagttctcgcgttttggctttatcatctctaactgcttcaaattggtggaaaatttcanctgacatcttggattccnggcactncattatgcaaaaagagtgcgtcnttgtaacttgcgataggcataatgcctatgaaaaatggnttgntcaagtgcttagtggcatggtaaatttcaatgattttctctttgctgtacacgggttgtgttatnaaataagacattccgcttnctatctttntnctctaatcttnngacggcaccatctaatttacgaacatcagggttaaaggcgccagcgatgttgaagtgtgtacgtttcttcagcgcatcacccccagngttaataccctgattaaatcttagagcgagttcancnaatcctttaggaattaacatcatagacattggttgcacctggtaagtgaccaactttggaaggatcaccagttatggctaatatttcgttaacgccaatgagcgataatccaagtaaatgggactgcaagccgattaagtttcggtctcgacatgtaatatgtacgagtggntcaatattgtaatattgcttaattaagctagcagcagcaatattgctaattctgacagttgccaatgaattatctgcgagtgttaccgcatctacattagctttatcaagtttagcgatattttcaaaaaatctatccgtgtctaaatgtttcggtgtatccaattcgataataacggttggacgttcttgaaccttagatgttaatgattgtctaactttattttgagatggattgaaaagtgctttcgttggtatcggaatcacttttntgncantaacaggtttaagtgtcngaatagattctttaataaatttgatgtgctctggcgttgtaccacagcaaccaccaattaaacgaacaccttcgcgaattagtgccattntggngnaacttgaccgaaatattgt

SEQ ID NO: 224 - DNA (Genomic DNA), 1886 bp; single-stranded, linear
ttatttaaaagtatccaatagccaacaatctctttcatctttgagtagtatcccacgtatttcgggattgcatccgagttgatttttatnattttcttcaatgctatcaagcgcagctcgtttacgtcttactttaggttttatttgctcaattgccttgattgtttgatttctaacatcagtaacagcagcatcttgatttgtattttctatttcttgttgcgcttgtttgagtgtgtcgctaattaattgattcgcttcatctaattcatcaactgttgcatgtggtgtatcttttattgattctacttgattttctgcagttgcttttattgcttgttgtgcttcaggcttaattacaatatgaggttgcacgagcaccttttagtgtagcaatgccattngtttcaacacgtttcacatcattantcgtgactgcttgattgaggttttgtaatgcaagtttttcattattcgctaattgatttaaagcaacttgtttttcttcatcagtcncatgttcagcttgctctatttcttgctttttagcctcatattgttgctttactgcatctcnagcagctgctctaaaaatatgttcaggcgctactaaagcaatgctatcaagcgcttgacttgttgtatcatcaacttgttgatttgttctattattcgtaatatctgtcatggcttgatttacaaattcntatgntnttatctagtgctacgttgtcnntcngcctgctgttgcntctttatccctgantaatcgtagcacagtaaatcattcgcntgttggattgagtttttccacgttgccagctggnggtaactttttgtttcagggtgaataatnttaatcgctgatacaccatttgttcctgcttgattcacctgacnattcgtttgagcntggtcaatanctccaagtgctttttctttttctttagctaatgcttgtgaagcaacttctttctcatnatctgttgaatcaagactattatcaatttgctgttgcttttctttaacagctttttcaanatctgcaattgcctttggtttaattactacttcagctncaacattatctatagcatttaccgcttgatttgtagttgtgtctacctgatcatttgtttggttttgattaatttgattaattgcttgatctttaagttgagtgatttgattaacagcagcctgcttttcttcgtcagttgcattaggtgtttgtttaaccgcttcaatacgcttcgccacttcagcagtgattttatctcgcgctgcttgtttttttactacatcaacttgaacagcatcgatattattctctgctactgtcgcagcttggtctacttctgcatttgtgttagcttgtttaatacttcnaatagctngttgtctgtcttgatttaaagtatagatcgcagcatttntctcagcattcgttgcatctggtgtagcattgatttcagctaatttagcattataatgctgattgatttgtgctaatgctgcaggtttattaacaatatttggctgaatcgcattaattgcttttgtacctaattgttgcgcttgatctacttccgcatttgtatcagcttgatttatattattaattgccgttgctaactcttgatccacttgatttaaagccacttgcttttcttcagttgttgcatttgtgttttgattaatttcttgctttttagcagttgctaaatcatttaatacacctgtagcaggttgtttcttcgttacatgcggttgactgcgccgatttgatgactgcatcgnctctaatactattgaccaccgagtagtagacgtcacacaatatcagtaatgctctattttagtgattgaaacgaatatcggtcttg

SEQ ID NO: 225 - DNA (Genomic DNA), 1381 bp; single-stranded, linear
ggcacgagacaatatatctaccgtgaataactgtgcaaatagtgaagttgtagccgccatacgcatttcattttcatcagttctgccataaatcaatgcatagtcggcaatttgagccacgtgccgattattcggcacgagctgtactagatatagttatgatgggaatactgtaatgtgtggccacctgtgcaattgactgcaattcactatgactaccttgattcgtcacaaaaatcatgcaatctctatcatcatgcgtcgcaaatgttgacacaagtaaatgcgtttcatgtaataacctgacatttaagccaatacgagataacttttgaaaaagatcaccaatagtcaaactcgatgcgccaaatccaaataaaaatattgtcctggcatttttcaacacatcacaaattgcatcaatttgcgcatccataatattagtagctacaaatcgcatccgtattccgttgctctagcaatcattttatttttcaaagtttctacagattcattttcaatcaattctaaatgtggattggttgcaatatcttcgggtaagtatcgagatatcgcaatctttagctcttgaaaaccttgatgtgtcattttccgactaaatctaacaattgatgctgtactaacattcgtaacatctgccaaatcattcaccgtcatatcaatgattttatgtggattctttaaaatgtaatcagcgattatcttttctgtcttcgtaaaatcactcaactgtttatcaatgcgatattaaaatatttgtcatcattaatcacccaacaaatctgtcttgtcgcatcgcctttgtcggtccaaataaatatgtacaaacgaatccaccagcatatgcagcaagtaatcctgcaatataacctaaatacatattatctgagattaatggtaagagtgacacaccacttgggcctattgctttggcaccaatatgtccaattccacctattacagcgccaccaataccaccaccaatacaagcagttaagaaaggtcgaactaatgggcaaagtcacaccatagattaatggttctccgatacctaggaaaccaactggcaatgcaccttttaaagtattacgtaatgttgtgttgcgtttacatcttacccaaagtgctaatgcggcacctacttgtccagcacccagccatcgctgcaattggcaataagtaagtagcaccagattggttaatcaatttctatatgaattggcgtnaaaaatatgatgaaggccctaacaataacttaacggtaggaagcttggtccaaatgataaatccacttaaattacgncacccaatacttaataatccccgttactactgaaacttaanttgtctttgaaacaaa

SEQ ID NO: 226 - DNA (Genomic DNA), 724 bp; single-stranded, linear
ggcacgagcgttttagttgatgtgtatcactaatatctttgaaaattttaatcaggtactacgacaatatgatgtctgttttgtgtctgaaagttttacagtttttaaaataaaaatggtataaagtgtgatttgtataaaaaagagtctcgacggataagaattgattaataacagttagcattttattaattaccttaacaatgattcaagtttagttaaatgaggtttaatttgaaaggggatagcgcctcaatataatgtaggtagattgttcatattacgtaattgaaaaatcaaatttaaatanatagggtggggctnnaaattatgaaatttaaagcgatagcaaaancaagtttagcattgggaatgttagcaacaggtgtaattacatcgaatgtacaatcagtacaagcganaacagaagttanacaacaaagtgaatcagagttganacactattataataaaccggttttagagcgtaaaaatgttactggatatanatatactgaaaaaggtaaagattatatagatgtcatagtagacaatcaatattctcaaatttctttagttcggatctgaataaagacanatttnaagatggagacaactcgnatatagatgtgtttatccttagagaaggtgacagtagacaagcaacnaattactcaattggtggcgtaacacaaacaaacagtcaaccttttattgactatag

SEQ ID NO: 227 - DNA (Genomic DNA), 618 bp; single-stranded, linear
ccttcaccaatacgtgtantatcnttatttgggcgnttgtccacttacccatgtaatcgtggcatctggaatggcactaccattagataacttaaagtaatctgctgcactagaaccattacctgctgggaagtcttggccttgtacagtgtaatgcgaatgtgcaacgatttctggaatgacatgctttacaggtacagtcactgttgatgttgttccatcttgatgagtaacagttactgtgacattggcattatttccagtacgactgacattactaactgttttactagtgatttcatttgcgcttgctgttgcatagtttctatttggtgcattacttgtaaacgttaacgaattaataattgtcgcttgatcagcttgtgatactgtcgcattattcgaaatattggcaattctaacaggattagcagnccgttgatgaagtaccaactcgatatttatcacgcaaaggtttcactgttacattgaatgaagttgtagctgtattaccactngtatcagttgctaataaattgattgtcttactagttgctgatgtcacatttggtgccgttgcagaaacatgttgatggttattatcaacagtctcgtgcc

SEQ ID NO: 228 - DNA (Genomic DNA), 1005 bp; single-stranded, linear
ttgtgagacacacgcttagtgcacatgacaatgtgaatgttgttgcacaaattattaaaagaagacttaccactgttaagttgtatcgagccgaatgatacatttgattttccacnaaactagggagtgtaagaagtgatggaaaatagtaggcccgagcgtaatgaagcgacgatgcatcttgatgaaatgactgtggaagaggctttaattacgatgaataaagaagatcagcaagtcccgttagcagttcgaaaggcaataccacaattgacaaaagtaataaaaaaaacaattgcacagtataaaaagggtggacgattgatctatatcggtgcaggtacaagtggaagattgggtgtcttagatgcagcggagtgtgtacctacattcaatactgaccctcatgaaattataggtattattgctggtggacaacatgctatgacgatggctgtagaaggtgcggaagatcacaaaaaattagcggaagaagatttgaaaaatatagatttaacatcaaaagatgtcgttataggaattgccgcgagtggcaaaacgccatatgttataggcggtttaacatttgctaacacaatcggtgctacaacagtatctatttcatgcaatgaacatgcagttataagtgaaattgcgcagtatccagtagaagttaaagttggtccagaagtattaactggttcancacgtttaaagtctggtacagcacaaaagttaattttaaatatgatttcaaccatcacaatggttggtgtcggaaaagtttacgataacctcatgattgatgttaaagcaaccaatcaaaaactgatcgaccgttcagtgcgtattattcaagaaatatgtgctatcacatatgatgaagcaatggcgttatatcaggtatctgagcatgatgttgaaagttgcgacagttatgggtatgtgtggcatttctaagggaagaagcaacaagacggttattaaaacaatggtgaccttgtt

SEQ ID NO: 229 - DNA (Genomic DNA), 1040 bp; single-stranded, linear
ggcacgagcgatgacaggaatatgatattgttttgcagctaacgcaacgcctacgggtgttttaccaaagatggtctgataatccatgcgtccttctccagtaataacgaggtctgcatctttaattctttgatgaaaatctgtaatgtcaaagacgacatcaataccttttgttaaagttgtctcacaaaacgctaataatgctgcgcccataccgccagctgcaccagaacctggtatttgattatacggactttcctgtgcacatttttatcttatcatgacaatgngacattgcgaaatccaaattaggtatgcatctttgcatcagcgcatttttgaggaccataaatataggtagcaccattttcacccaataaaggatttgaaacatcacaggccactttaaaggtcacctcttttantcgcgaatcggccagattggttatatcgatttgtgcaatgtgagcaagattagcaccattcatttgtaataagtccccgtttacatcagtaaactttacgcctagtgcacttagcatacctgtaccaccatcatttgttgcactgccaccaatccctaaaataatggtcttagcaccatgatttaatgcatctttaattagttcaccggtaccatatgatgatgtgtataaaggattacgttcctctttttctaataaatccaaacctgacgctgccgccatttcaataattgcaatttgttgttcgtctgcgcgtgcataacatgcttcaataggtcgcattaaagggtcattaacgatgactgtatacttagtggcanctgntgcatgaattaangcatctgnggtaccttcaccaccatcaggcatcggaatgatatcataatgaagggtattcccataaacattagtaaatgcctgttttataatattgncaacttggtgtgnggncatactttccttaaatgagtcaggagcgatgacaatttgttgggaatggatggnagncaccnctcaatatgnnggcgntcttttggttttanattntagtgactn

SEQ ID NO: 230 - DNA (Genomic DNA), 1291 bp; single-stranded, linear
tgtataggcctatttgtatanaaagtaatatgatgtttagtggctatgtaagtgaagcaatgtataaataatgatgagtggtttgttactaatgataatggctatgtaaaagagcagtatttatatttngcgggacgtcaacaggatatgttaattattggtgggcgaaatatatatccagcacatgttgtncgccttttaacgcaatcttcgagcattgatgaagcaattatcatcggtattccacatgagcgttttggtcanataggcgtattgctttattctggtgatgtgacacttacacataaaaatgngaaacaatttttnaaaaagaaagtgaaacgccatgaaattccattcgatgattcatcatgtagaaaagatgtattacnctgcaagtggtaaaattgctagagaaaaaatgatgtcgatgtatttgagaggtgaattataatatgaatcaagcagtcatagttgcagctaaaccgaactgcatttgggnaatatggtggcactttaaaacatttagagccagaacaattgcttaaacctttattccaacattttaaagagaagtatccagaggtaatatctaaaatagatgatgtagttttaggtaatgttgttgggantggtggcaatattgcaagaaaagcattgcttgaagcggggcttaaagattcaatacctggcgtcacaatcgatcggcaatgtgggtctggacttngaaagtgttcaatatgcatgtcgcatgatccaagccggagctggcaaggtatatnttgcaggtggtgtttganagtacaagtcgagcaccttggaaaatcaaacgaccgcantctgtgtacgaaacagcattaccngagtttttatgagcgtgcatcatttgcacctgaaatgagcgacccatcacatgattcaaggtgctgaaaatgtggccaagatgtatgatgtttcaagagaattacaagatgaatttgcttatcgaagtcatcaactgacagcggaaaatgtaaagaatggaaatatttctcaggaaatattacctataaccgttaaaggagaaatattcaatactgatgaaagtctaaaatcacatattccgaaagataactttggccgatttaagcccgtaatcaaaggtgggaccgttaccgctgcgaatagttgtatgaaaaatgatggtgcagttttattgcttattatggaaaaagatatggcatacgaattaggtttcgagcatggtttattatttaaagaatggtgttacggtaggtgttgattctaattt

SEQ ID NO: 231 - DNA (Genomic DNA), 557 bp; single-stranded, linear
cattcatctaacctnttcatcagttgagtgattttaatctatccttcaaaagttngnggatcaggtccaattctcttatctagatttaaaccaggcacgagcgtcatttgttcatctgataattcgaaatcaaatatttggaagttttcagagattctgtttggtgttaccgatttagggattataaccacaccatgctgcacattccatcttaaaacaacttgggcaggtgactttcctaattcttgagcaatgtctttaattgtctcatcatttaaaatttgtgcattcatcaatggtgaccaagattccatcacgatatgttgtgctgccaaatataatttcaatttatgttgcgttaaatatggatgatattcaacttgattaattacaggtttaattgacacttgtgccaacaaagcttccaaatgttcaggttcaaaaattgctgacacctatatttttagctttattatttttatataaatcttccatacctttccatgttatcaaccattacggcttcgttcgtgcctggccaatgttactarrdctns

SEQ ID NO: 232 - DNA (Genomic DNA), 904 bp; single-stranded, linear
ggcacaattcggcacgagcgttggtatgtagaatatgatggtgaatggtatgtgtataacgatgggaggcttgaataaatgaactggaaactgacaaagacacttttcattttcgtgtttattcttgtcaacatcgggttagtatcgatttatgttaataaagtcaatcgctcacacattaatgaagttgagagtaacaatgaagttaattttcagcaagaagaaattaangnaccggctagtatattgaataaatcaggtaaaggtataaaatgagagcaaattacagggcgatcaaaagactttagttctaaagctaagggcgattcggatttgaccacatcagatggtggaaaattattgaatgcgaacattagtcaatcggtaaaggtcagtgacaataacttaaaagatttgaaagattatgttaacaaacgtgtgttcaaaggttcagaatatcaattaagtgaaattaattctggttctgtaaaatacgaacaaacgtatgataatttcccgattttgaacaatagtaaagcgatgttgaactttaatatagaagataacaaagcggctagttataaacaatcaatgatggatgacattaagcccacagatggtgcagataagaagcatcaagttattggagtgagaaaagcaatcgaggcattatagtataatcgttacttgaaaaaaggtgatgaagtcattaatgctagactcggttactactcagtcgtgaacgaaacgaatgttcaattgttacaaccaaactgggaaattaaagtgaagcatgacggtaaggacaaaacgaatacttactatgtcgaagcgacaaataataaccctaaaattattaatcattaatatgaatcgtaataagctagtattgcaagctcgtgcc

SEQ ID NO: 233 - DNA (Genomic DNA), 699 bp; single-stranded, linear
ttgtaccaccacagttgtcacggagaccataaagatgccgaggagtaaaagtaaaaagaaccaaatagaattgataccagcggctgatatgttaaacttgttagggtttgaattacaaccaactaatgatggattgattattcatccgtcaagaatttaaaacaaatgcaacagttgatagtttaactgatcatcgaataggaatgatgcttgcagttgcttctctactttcaagcgagcctgtcaaaatcaaacaatttgatgctgtaaatgtatcatttccaggatttttaccaaaactaaagcttttagaaaatgagggataatataaaatggaagatatctataaattaatagacgatatcaatctacaaaaactagaaaatttagactctcgtgttaatgaagcaataactactgacaacgatgacgcattatttattctaggagagacactttacaattttggattaatgccacaaggtttggaagtattccgctcgtgccatatcncaaatatccagncganagtgangtgctgatttattttattgaaggtttaatgtctganaatcaacctgccgaagcgttagaananttaagttatgttgatccatcacctgcnnagttgatgttnaagaaatagttttgcganntgattatctaaaacagtattcagaanttatttggtagaaaata

SEQ ID NO: 234 - DNA (Genomic DNA), 654 bp; single-stranded, linear
ccaaacaacctatccttcaaacaattatccaatatttgttgaacatggtgcaattgaccatattagcacgtatattgatcagtttgatcaaagttttatattaattgacgagcatgtaaatcaatattntgctgaaaantttgattgaaattttaatcaaattgaaaatgtccataaagttcattaatccnaacctggtgaaaaagacggaaaacatttgaccaatatcaaagaaacattagaatacattntggtcacatcatgtaacgcgtaatacagcgattatagctgttggtggtggtgcgacaggagattttgcaggatttgtagcagcaacactattaagaggtgtccattttatacaagttcctacaacgattttggcgcatgattctagtgttggcggtaaagtgggtattaactcaaaacaaggtaaaaaccttatcggtgcattttatcgtccaactgctgtgatttatgatttagactttttaaagacgttaccatttgagcaaatattaagtggctatgcagaagtttataagcatgcgttattgaatggtgaatcaacgacgcaagaaatcgaacagcactttaaagatagagagatattacagccattaaatggtattggataaatatattgctaaaggt

SEQ ID NO: 235 - DNA (Genomic DNA), 880 bp; single-stranded, linear
ctaactttcgctttttctttttcttcaatgtcttgcacttgtctttcaacaatgttaaatctttgttgtaaacctgctttttctgtttctagttgtttgatgtcttccatatcaatatttggatctgttgctttctgactcaattcatcatttttattttttaattgntgtccaatcatacctaaggattgtttnaattcatataatgtcggcatntcatttcctcctaataantcattgtcatttttaaaatttcgcattcgagcgtacaatntnntctctntnntcttnctcttctagcgacatactttctttaggtggtttcaaccaatccagatcgtatctnacatcatcaattttagtgattttntctacatctttctttaaatcttctgggacnttctcnaaacgcctacattgctctttagagatactagcagctatttcattagctcctaaaatttcatctatcaagccgaaagacaaggcttcttctgcagtaagccaagtttctgcatctaacatctgttttaagtgttcttgatctaaatctnttgntttatctaaataagctgaattactaacagcatctgttttttcaagtaaatccgctgtctttcttaattcttctgcattacctacagtcataacccatgaattatgaatcattaaaaaactattnntggggcataaaaatagtgtcaccactcatagggataacaactagcaattggatgccgctaaggcatcgacatagatattanttnntggaggatgcatttntagcatattggntttttggatgntccncaaatacantggctccagatgaatttatattgaacaactttttcaactgatgtctccnnggtcaacttag

SEQ ID NO: 236 - DNA (Genomic DNA), 830 bp; single-stranded, linear
agtatttttttgaccgagacatgcaagccctcctggttgattatcatttacatatcgtatcataaccaatcataaacaatagttttattaacttgtagacacaatgtttgctaaagtcatttttaaaaaatatagccaaaaaattagctatatattataaaagcgtgatataaatgttttatataacaaagaaataaaaatcattttttacaaatggttgtaagaaaaagacatgcagatgttgttaaaattttaataagaatcaaggaggctatattatatggctaaactaaatgtagaagtatttgcggacggtgcagatattgaagaaatgaaagcagcttataaaaacaaacaagtggatggttttacaacaaatcctagtttaatgccgaaagcggccgtaagcagattacaaagcttttgctgaagaagctcgtgaaagaaattccagatgcttcaatttcatttgaagtatttgcagacgatttagaaactatggaaaaagaagcagcaattttaaaacaatatggcgaaaatgtatttgttaaaattcctattgtaaatacaaaaggtgaatcaacgattcctttaattaaaaaactttcagctgacaatgtgagattaaacgttncggctgtttacacaattgaacaaggtaaagaaataactgaagcagtaactgaaggtgtgcccaacatatgtttcagtatttgcaggacgtattgcagatacaggcgtagatccattaccattaatgaaagaggctgtaaaagttacgcatagtaaagacggcgttaaattattatgggcaagttgccgctcgtgcc

SEQ ID NO: 237 - DNA (Genomic DNA), 789 bp; single-stranded, linear
nttaattttaaaatgtacaatgatatntgtgaaagcgcttgcttaggaggtgtatntgagagtgaatgaaatgaatgctaaagaacnattagtggacnatttaatgaaaacatcatcgcaattatttaaattncacggtgaagttgncatgcagcttntcttaaatgatgaattaaaattaccttctattgntgaaatatgcgtggaacgtaagcgtttaagtgatattgtgaaagttattccgcaatcatatgcgttactatacatagataagcaagatcaagcaagagctaaagannatttatcacttncaaaaattgcaaaagtttatgtgcaatatgatgatacaacaataatgagtattttcgtttatgatgtagtaaacgatgaatggattttaagattggatccgaatatacgtatacctaagagtaacatatacttccatagtttaaattgggatgtggattatattaaaccggagatcgttctaatgtatgatctaatgcaacaccatcagtatcatcattattccaattataaacgagtcatagatgcnttaagctactatcaattttttattttaaaatttgtagtaggtgagcnacgtattaaggatgcaatccagaagaacaataaataattaagaaaaagcaattcataacgcagttgaatacatgtgttacgaattgcttttatattagtttttatcacacaagttttttaatgcaacnccgtgatagcaaaactcatatgtagataatacagctttttcagcatcatctacat

SEQ ID NO: 238 - DNA (Genomic DNA), 605 bp; single-stranded, linear
atattcgagacgaccctaantaattgtgttgtctgtcatactgggncangatttgtgtgnctanatacnactnatcattagcantagattgtttatatgttgttgagtggcaaaattgttgtggtgcgtgtggggttgcntgctgagatgagtgagtatattgttgagtattatatggctctggtgttgggtgttgcgcctgtggcacgttagnctcgagccgctgggtgtgtattatcatcagttttcttctgagtatcatctgagntatcttgagatgcattgtcatccttatctttcgactcatcctntgatgctttatcatcattctcntctttagcaggacgttgctttgtaggtgcttgttgctgaggtggcacatattgatattgattctgctgtggcaattgctgatattggtttgcttgtgaatctagctcagcctgctttttttcctcttgttgctttnnctttctctctttatctgcaatttctttttgacgcttttctttttgttcctgctttttgttcgttcaacatacgttctttagctttattcgaatgaatctacatatgcaaaaattgcaaatactaaatcctcccga

SEQ ID NO: 239 - DNA (Genomic DNA), 683 bp; single-stranded, linear
ggcacgagactggtggaggttcaggtaactcgccggcacgattaatgcctgataaaatattggatttaaagtataagttgcgtgttaataatgtaccgacaccaagaacagtaacatttaatgatacattaacatataaaacatatacacaagattttattaattcacctgctgaaagtcatactgtaagtacaaatccatatacaatcgatatcatcatgaataaagatgcattacaagccgaggttgatagacgcatggcaacaagctgattatacatttgcatcattagatatctttaatgatcttaaaagacgtgcacnaacgattttagatgaaaatcgtaacaatgtaccattaaataaaagagtttctcaagcanatattgattcattaactaatcaaatgcaacatacgttaattcgaagtgttgatgctgaaaatgcngttaataaaaaagttgacacaaatggaagatttagttaatcaaaatgatganttgacagatgaagaaaaacaagcngcaatacaagttatcgaggaacataaaaatgaaataattggtaatattggtgaccaaacgactgatgatggcgttactagaatcacaagatcaaggtatacagaccttaagtggggatactgcaacaccggttgttaaaccaaatgctaggaaaagcaat

SEQ ID NO: 240 - DNA (Genomic DNA), 932 bp; single-stranded, linear
tgatgattagataaattgaaacaacaacgtattgagttgaatgaacaaatcgatgcgcaggaagctacatacaagtttgtcaccaagatattttagctatcgaaaatcactaccaagatattaaagctgaacaatcaaagttaggatgtattaattcatcatgcgatagatcatttaaatgatgaatatcaattgactgttgaacgtgcgaaatctgaatatacgagtgatgaatcgattgacgcattacgtaaaaaagttaagttaatgaagatgtccgattgatgaactaggtcctgtaaacttaaatgcaattgaacaatttgaagagttaaatgaacgttatacatttttaagtgaacaacgtacagatcttcgtaaagctaaagaaacattagagcaaattataagtgaaatggatcaagaggttactgaaagatttaaagaaactttccatgctattcaaggacattttacagctcgtgcccaaacaattgtttggtggaggcgatgcagaattgcaattaactgaagccgattatttaacagctggtattgatattgtggtacaaccaccgggtaaaaagttgcaacatttatcgttactgagtggtggtgagcgtgcattaactgctattgctttactatttgcaattttaaaagtaagatctgcaccttttgttatattagatgaggttgaagctgcactagatgaagcaaatgttattagatacgcaaaatatttaaatgagttatcagacgaaacacaattcattgttattacacaccgtaaaggaacaatggaatttgcagataggttatacggtgtaacaatgcaagaatcaggtgttactaaacttgtgagtgtgaatttaaatacaatagatgatgtgttgaaggaggagcaataatgagcggcacgagctcgtgcc

SEQ ID NO: 241 - DNA (Genomic DNA), 966 bp; single-stranded, linear
cggttaatcggtagtattttaggttcngttgttattaagatttgggaagatttgatcttccatcccccaaagggnttaaccgtatggggatncntcanaatcatttgcccaagctaaaccaccaaagaatggatatttgaatccggttgcatttaagntcaattgggatgatttttagcctccagttattaagttcaagtgttaaataccctgttctaattttaattaattctattaatttaagatacttaaaatgataagacactaagaaagggaggctattagtaataatgcccaaaaataaaagcaaatgaagcattagttaaagcattacaagcatgggatatagatcacttgtatggtattccaggagactcaatcgacgcagttgtcgattagtttaacgtacagtgagagatcaatttaaattttatcatgtacgtcatgaagaagtagcaagcttagcggctgctggttacacaaaattaactggtnaaatcggtgtggcattaagtatcggtgnccctggtttaattcatttattaaatggtatgtacgatgccaaaatggataatgtactcgtgccaattaatattatctggacaaacngaatagtacagcacttggaacgaaagcatttcaagaaacaaatttacaaaaattatgtgaagatgtagccgtttataatcaccaaattgaaaaaggtgacaatgtgtttgaaatcgttaacgaagcaattcgtacggcatatgaacaaaaaggtgtcgctgttgttatttgtcctaacgacttattaactgaaaaaattaaagatacaacgaataaaccagtagatacatcaagaccaacagttgtatcaccaaaatataaagacatcaaaaaagcggttaaactaattaataaaagtaaaaagcctgtcatgttaattggtgtaggtgcaaaacatgcgaaagatgagctcgtgcc

SEQ ID NO: 242 - DNA (Genomic DNA), 1396 bp; single-stranded, linear
ctgtgaaattaagtcgntattacccgcaaggattaagaagtttgaatggtggtcgcatggcaagatttggacgtacaccattacttgatgcaatggagatggctaatgagcatattatggtgattgccatgatagaagatgttganggggttatggccattgacgatatagctcaagtcgaaggtttagacatgatagtcgaaggtgccgcaggatttatcgcagtcacttggcataccatngcaaacgagcgtgatgatcaagtaacatcacatnttcaacatatttntgnggttgtgaatgcacatggtaaacatttntgtgcattaccacgtgaagatgaagatattgcaaaatggcaggcacaaggtgtacaaacatttattttaggcacgagcggaaaaatatatcgccatttaagtgcatctctagcgacgtctaaacagaaaggggatgatggctaatgcgtatagttcaacctgttattgaacaattaaaagcacaatctcatccagtttgtcattatatctatgatttagtcggactggaacatcatttgcaacatattacatcgtcattgccgagtaattgtcaaatgtactatgcaatgaaagcaaatagtgaacgaacaatcctagatacaattagtcagtatgttgaaggattcgaagttgcatctcaaggtgaaatagcaaaaggtcttgcttttaaaccagcaaatcatattatttttggtggccctggtaagacagacgaggaactaagatatgcagtaagtgaaggtgttcagcgtattcatgttgaaagtatgcatgaattacaacggctaaatgccatcttagaagatgaagataagacacaacacattttattgcgtgttaatttagcaggaccatttcccaatgcaacgttgcatatggcaggacgcccaacacaatttggtatttctgaagacgaagttgatgatgtcattgaagctgcgctagtaatgccaaatattcatctagatggctttcatcttcattcctatttctaacaatttagactcgaatttacatgtcgatgtaggggaaactttattttaaaaaagcaaaatcatggccttgaaaaacatcgatttccactcaaacatatcaatcttggtgggtggcataggcggtcaactatgcagatttaactaggccaactngagtgggataattttgnngaaaatttnaaaacacttatcgttgagcaagaaatggaagatgtgacattgaactttgaatgtgggcgctntattgtggcacattggggttactatgtgacagaagtgctagatattangaaagngcatggcgcttggtatgccatttnaagaggaggtacgcaacaacntagcctgccggnatcttgc

SEQ ID NO: 243 - DNA (Genomic DNA), 3918 bp; single-stranded, linear
accaaagccaaatacttgcattaanncggggtaattccaacaacttaagaacngtgcgaaacnagcctgcggaacnacaagcgattaccaaatgcttcgggacnttaaaataccacaacacaaagaagcattgtaagcacaagtaacaagtgcaggacgcgtatctgcagcanatggtgttgaacatactgcgactgaattaaatactgcgatgacagctttaaaacgtgccattgctgataaagctgacacacaagctagtggtaattatgtcaatgctgatgcgaataaacgccaagcatatgatgaaaaagtgacagctgcagaacatatcgttagtggtacaccaacaccaacgttaacnccatcagatgttacaaatgcagcaacgcaagtaacgaatgcgaagacgcagttanncggtaatcataatttagaagtagcgacncaaaatgctaacacagcaattgatggtttaacttctttaaatggtcctccaaaaacccaaaacttaaagaacaagtgggtcaagcgacngacgttnccaaatgttcaaactgttcgtgataatgcacaaacattaaacactgcaatgaaaggtctacgagatagcattgcgaatgaagcaacgattaaagcaggtcaaaactacacagatgcaagtcaaaacaaacaaaatgactacaacaatgcagtcactgcagcanaagcaatcattggtcaaacaactagtccatcaatgattgcgcaagaaattaatcaagcgaaagaccaagtgacagctaaacaacaagcgttaaacggtcaaagaaaacttaagaactncgcaaaccaaatgcgaagcaacaattgaatggcttaagtgacttaacttaatgccccccaaagatgnagcganaccnccaaatcgaggtgcaacgcatgttaatggaagtaaacacccaagcccacaataatggggacggcattaaaatacaagctatgncggnacttgtnaaatggtaattcaaagactcacaatncggattaagcaaggtgttaacttcacttgatgcagatgaagcgaaacgtaatgcatatacaaatgcagtgacgcaagctgancaaattttaaataaagcacaagggccaaatactgcaaaagacggtgtcgaaactgcgttacaaaatgtacaacgtgctaaaaacgaattgagcggtaatcaaaatgttgcgaacgctaagacaactgcgaaaaatgcattgaataaccttacatcaattaataatgcacacaaagcagcattgaaatcacaaattgaaggtgcgacaacagttgcaggtgtaaatcaagtgtctacaatggcatcttgaattaaatacctgcaattgagcaacttaccaacgtggtattaatgacgaagcagctacaaaagcagctcagaaatatactgaagcagatagagataaacccancctgcatacaatgatgctgtaacagcagctaaaacgttattagataaaacagctggttcaaatgacaataaagtagccgttgaacaagcattacaacgtgtgaatactgctaaaacagcattaaatggtgacgcgcgattaaatgaagcgaagaacacagctaaacaacaattagcgacaatgtcacatttaactaatgctcaaaaagcaaacttaacagaacaaattgaacgtggtacaactgttgctggtgttcaaggcatccaagcaaatgctggtactttaaatcaagcaatgaatcaattaagacaaagtattgcttctaaagatgcgactaaatcaagcgaagattatcaagacgcgaatgcagatttacaaaatgcatacaatgatgcggtaactaatgctggaggtattattagtgcancgaataaccctgaaatgaatcctgatacaattanccaaaaagcgagccaagtgaacagtgcgaagtctgcattgancggtgatgaaaaattagcagcagcaaaacaaactgcgaaatcagatatcggtcgtgtgacagacttgaacaatgcacaacgaactgcgncaaatgctgaagtggatcaagcaccaantcttgcagctgtcacagcggctaaaaataaagcaacatcgttaaacacagcgatgggtaatgtgaaacatgcacttgctgaaaaggataatacganacgtagtgtcaattacacagatgcggatcaaccaanacaacaagcgtntgatactgcaggtacacaagcagaagcaattactaatgcaaatggcagtnacgcgaatgaaacacaagttcaagcagcgcttaaccaattgaatcaagctaaaaacgacttggaatgggtgataataaagttgctcaagcgaaagaaacaacaaaacgtgcattagcttcatatagtaacttgaataacgcgcaatcaactgcagcaactagtcaaattgacaatgcaacgacagtagcagacgtaactgctgcacaaaatactgctaatgaattaaatacagcaatgggtcaacttcaaaatggtattaatgaccaaaacactgttaaacaacaagtgaactttacagatgctgaccaaggtaagaaagatgcttacacaaatgctgttacgaatgctcaaggtattttagataaagcaacacggtccaaaatatgncaaaagcacaagttgaagctgcattaaatcnagtancgnctgctaagaatgctttaaacggtgatgcaaatgtnagacaancaaaatcagatgcgaaagcaaacttaggtacattaacacacttanataatgcacaaaaacaagatttaacatcacaaagcgnnggtgcaacaacagncaacggtgtaaatngtgttaaaacgaaagcacnagacttagatggtgcaatgcaacgattagagtcagcaatcgcaaataaagaccaaactaaagcgagcgaaaactacattgacgcagatccaactaagaaaacagcatttgataatgccatcacacaagctgaatcttacttaaataaagatcatggtacgaataaagataagcaagctgttgaacaagcaattcaaagtgtaacgtctactgaaaatgctttgaacggtgacgcgaacttacaacgcgctaaaactgaagctacacaagctatcgataacttgacacaattgaatacaccgcaaaaaacagcattgaaacaacaagtgaatgctgcacaacgcgtatcaggtgtaactgatctgaaaaatagtgctacatcacttaataatgcgatggatcaattaaaacaagcaattggtgatcatgacacaattgtagctggtggtaattacactaacgcaagtcctgataaacaaggtgcttacactgatgcatataatgctgcgaagaatatcgtaaatggttcacctaatgtgattacaaatgcagcagatgttactgcgncaacacaacgtgtcaataatgctgaaacaagtttaaatggtgagacaaacttagcaactggcgaagcaacaagctaaagatgcattacgtcaaatgacacatttatctgatgcacaanaaacaaagtattactggtcaaattgatagcgcgacacaagtaactggtgtacaaagtgtgaaagacaatgcaacaantcttgacaatgcaatgaatcaacttcgaaatagtattgcgaataaagatgaagtaaaagcgagtcaaccatatgttgatgcagatacagataaacaaaatgcatacaatacagcagttacaagtgctgaaaatatcattaatgcaacgagtcagccaacacttgatccatctgcagtaacacaagcagctaatcaagtgaacactaacaaaactgcgcttaatggtgcgcaaaacttagcanataaaaagcaagaaacaactgctaacatcacccgattaagtcattta

SEQ ID NO: 244 - DNA (Genomic DNA), 1265 bp; single-stranded, linear
atgcgatacgcttaaccagcaatgcatggtttaagacagagcattcaagataacgcagcanctaaaccgaatagcaaatatatcaacggaagtccacgagagcaaccaaaactatgatcaagctgttcaagccccaaataatattatcaatgaacaaactgcaacattagataataatgcgattaatcaagtagcggcaactgtgaatacaacgaaagcagcattacatggtgatgtgaaattacaaaatgataaagatcatgctaaacaaacggttagccaattagcacatctaaacaatgcacaaaaacatatggaagatacgttaattgatagtgaaacaactagaacagcagttaagcaagatttgactgaagtacaagcattagatcaacttatggatgcattacaacaaagtattgctgacaaagatgcaacacgtgcgagcagtgcatatgtcaatgcagaaccgaataaaaaacaagcctatgatgaagcagttcaaaatgctgagtctatcattgcaggattaaataatccaactatcaataaaggtaatgtatcaagtgcgactcaagcagtaatatcatctaaaaatgcattagatggtgttgaacgattagctcaagataagcaaactgctggaaattctctaaatcatttagatcaattaacaccagctcaacaacaagcgctagaaaatcaaattaataatgcaacaactcgtgataaagtggctgaaatcattgcacaagcgcaagcattaaatgaagcgatgaaagcattaaaanaaagtattaaggatcaaccacaaactgaagcaagtagtaaatttattaacgaggatcaagcgcaaaaagatgcatatacgcaagcagtacaacacgctcgaagatgccttgnttaacaaaacaactgatcctacattagctaaatcaatcattgatcaagcgacacaggcagtgactgatgctaaaaacaatttacatggtggatcaaaaactagctcaagatnagcaacgtgcaacagaaacgttaaataacttgtctnacttgaatacaccacaacgtcaagcacttganaatcaactcaattcntgcagcaactcgncgngangtagcacanaaatttactgangcacangcacnttatccacgcaatggangctttncgtcatagcattcacgnnncaacaaacaaaacagatctggtntgcaanttttttattgaaggttnnnccncaccccggtgcttccngcgccac

SEQ ID NO: 245 - DNA (Genomic DNA), 791 bp; single-stranded, linear
ttcattagtggtgtggcacgatagctcaangataaccaaactcctggaaattctctaaattcatttagatcaattaacaccagctcaacaacaagcgctagaaaatcaaattaataatgcaacaactcgtgataaagtggctgaaatcattgcacaagcgcaagcattaaatgaagcgatgaaagcattaaaagaaagtattaaggatcaaccacaaactgaagcaagtagtaaatttattaacgaggatcaagcgcaaaaagatgcatatacgcaagcagtacaacacgagcgaaagatttgattaacaaaacaactgatcctacattagctaaatcaatcattgatcaagcgacacaggcagtgactgatgctaaaaacaatttacatggtgatcaaaaactagctcaagataagcaacgtgcaacagaaacgttaaataacttgtctaacttgaatacaccacaacgtcaagcacttgaaaatcaaatcaataatgcagcaactcgtggtgaagtagcacaaaaattaactgaagcacaagcacttaaccaagcaatggaagctttacgtaatagcattcaagatcaacaacaaacagaatctggtagcaagtttattaatgaagataaaccgcaaaaagatgcttaccangcagcagttcaanatgcaaaagatttaattaaccaaacaggtantccaacgcttgataaagcacaagttgaacaattgacacatgcttttaaacaagctaaagataacctacacggtgatcaaaaacttgcagacga

SEQ ID NO: 246 - DNA (Genomic DNA), 3323 bp; single-stranded, linear
ctattaaggaatccttgnnaaattcacattagcaagttggattgtccaccttattaattgataaagtatgcaaataatttcacagtgtttccagcggggccaanttatgattgcaagtaacctatagcaatcgtattcttgttcttgccaacgctatttaagtatcaggtttaaccaacaggtgcgacaaaaggttagtttgaaattagggagtggggcagaattgataaagaaccactaatgacgataaagattaaaagggaggacgttatgatgacggattaaagttggaatcattgggtgtggtggtattgcgaatggcaagcaacatgccaagtttacnaaaagttgaaaatgttgaaatgatcgcattttgtgacgtagacatttcgaaagcagcgagtgcggcagaagcatacggaactgacaatgcaaaggtttatgatgattacaaagcattgttaaaagatgacacgattgatgttatccatgtttgtacgccaaatgactcgcattgtgaaattactgtagcagggttgcatgccggtaagcatgtgatgtgtgaaaaaccaatggctaaaacgacagcagaagctcaaaaaatgatagatacagctaaatcaacaggtaaaaaattaacaataggttatcaaaatcgcttcagaccagatagtcaatttttacatcaagcagcgcaacgtggcgacttaggagacatttacttcggaaaggcacatgccattcgtcgtcgtgcagtaccgacatggggtgtctttctaaacgaagaagcccaaggtggaggacctttaatcgatattggtacgcacgcattagatttaacgttatggatgatggataattatgaaccagaatcagtgatgggttcaacattccataaattaaataagcagcatgatgcgccaaacgcttggggttcatggaatccagatgaattaacagttgaagactctgcgtttggctttattaaatgaagaacggagcgacgatcattttagatccgcttgggcgattaattctttagaagtggatgaggcaaaatgttcattattaggaacgaaagcaggtgctgatatgaaagatgttctacgtattcatggtgaagatatgggcacactttataccaaacacgttgaattngaaaacaaaggcgtcgacttttatgaaggtaatgaagtggatgaagctgaagaagaancaaaagcttggattgatgcagttgtaaatgatactgaaccagttgtgaaaccggaacaagcaatggtagttacaaaaattcttgaagcgatttatcagtctgcaaaatcaggcaaagcaatttactttgaataacatcatacggtaaggaggcacatcatgacaaaattaaaagttggtgtgataggtgttggtggcattgcacaagaccgtcatattccagcattgctgaaactcaaagacacagtctcattagttgcagtacaagatattaatacagtgcagatgattgatgttgcgaagcgctttaatatacctcaggcagttgagacacctagcgagctgtttaaacttgttgatgcggtggtcatttgtacacccaataaattccatgctgatctttctatagaagcattgaaccatggtgtccatgtcttatgcgaaaagccaatgncaatgacgacggaagagtgtgatcgcatgattgaagcggctaataaaaatcacaaattattaactgtcgcttatcattatcgtcacacagatgtcgctatgactgctaaaaaagcaattgaagcaggtgtggttggtaaaccattagtagcaccgttgtccaancgatgcgtaggcgtaaagnacctgggtggggcgtttttacccaataaaaccgttgcaaggtggcggtagtttaatcgattatggtttcccacttgttaagacttatctttgtggctattaggtaaagatatggtgccgcatgaagtgctaggaaaaacatataatcaattgagcaaacaaccgaatcaaattaatgattggggaacatttgatcacactaaatttgatgtcgatgatcatgttactagttatatgacatttgccaatcgagcaagcatgcagtttgaatgttcgtggtctgcaaatataaaggaagataaggtacacgttagtttatcaggagaagatggcggtatcaatttatttccatttgaaatatatgagccccgctttggaactatttttgaaagcaaagctaatgttgagcataacgaagacattgctggtgagagacaggcgcgtaactttgtcaatgcgtgtttaggtatagaagagattgtggtgaaaccggaagaagcacgcaatgtaaatgcccttatagaagcgatttatcgtagcgatcttgataacaagagcatacaactttaatgattattatatataatacaaaattctcaatataaaaaganggagtgcttttcaatgaaaataggtgtattttcagtattattttacgataaaaattttgaagatatgttagattatgtcgcagaatctggattggatatgattgaagttggaacaggtggtaacccaggagataaattttgtaagttagatgagttgttagaaaatgaagacaagcgacaagcatttatgaagtcaatcacagacagaggcttacaaataagtggtttcagttgtcataacaatccaatttctccagatccgatagaagcgaaagaagccgatgaaacgttacgtaaaacaatccgtttagcaaatctattagacgtgccagttgttaatacattttctgncattgcagggtcagatgataccgctaaaaagcctaattggcctgttacaccttggccaacagcctactctgaaatttatgattatcagtggaatgaaaagttgataccatattggcaagatttagctgagtttccncaagagcaagatgtnnaaattgccatngagttacatncaggatttttagctcanacaccaaatacgatgttnaagttacgtgagccaacaaatgaatatatcggtgctaacttagatcctagtcatttatggtgncaaggtattgacccaantcctgcgantcgcatattaggcccnancaaatncaattcatcacttccatggaattccgaagaaacgtatgttantcnagggnatgtaaanatgtatggtctagctgatntccagccatatggtnacgttgcgacangngcatggacattccntacagntggntatggacatagtccatatgnatgggcagatntcataagtcaacttantattagatggag

SEQ ID NO: 247 - DNA (Genomic DNA), 641 bp; single-stranded, linear
tccatttaattccaccttgccccgacaggttttnccgacctggaaagcggtcagtgagcccnaacncaattaatgtgagttagctccacttcattaggccaccccaggcctttacactttatgcttccggctccgtatgttgtgtggaatttgtgagcggataacaatttcacacaggaaacagctatgnccatgattacnccaagctcgaaattaaccctcactaaagggaacacaagctggagctcccaccgcggtggcggccgctctagaactagtggatcccccgggctgcaggaattcgacgagaacgcgtgcagcgtttacagttgcgtctattgatttaggtgcgcatccagaatttttagggaaaaatgatattcaattagncaaaaaagaatctgtagaggatactncnaaagtattaggtagaatgttcgatggtattgaattcaaactttaactgagcttcatggggcaccaggttttgaagaagaagtaaaaaattatatgactcagcaaatggcgccgtatgtagatggaatttattgaaaatcgtatgggtggattttttgggtgtgaaaaaatctaaaaatccaaatgcaaaacgtgtaatgattgcagnacatatggatgaaatc

SEQ ID NO: 248 - DNA (Genomic DNA), 1130 bp; single-stranded, linear
ctgcttaaattcgaacgtgtcattgacattttcaataagaaaaacaacggagcatggaatttctgtccgcaaaacgccggttattgggaacatatccctaagagtattacaaaattatcagatttaaaaatcgttggtttagatttctatatcactactgaagaatcaaaacgatttactgattttcctaaagactttaaaggtattgcaggttggatattagaagtaaaatcgaatacaccaggtaacacaacacaagtattaagacgtaataacttcccgtctgcacatcaatttntagttagaaactttggcacgagactggtggcgttggtaaatgggagtttattcgaaggaaaggtggttgaataatgatagtagataatttttcaaaagacgataacttaatcgagttacaaacaacatcacaatataatccaattattgacacaaacatcagtttctatgaatcagatagaggaactggtgttttaaattttgcagtaactaagaataacagaccgttatctataagttctgaacatgttaagacatctatcgtgtaaaaacccgatgattataacgtagatagaggcgcttatattacagacgaattaacgatagtagacgcaattaatgggcgtttgcagtatgtgataccgaatgaatttttaaaacattcaggcaaggtgcatgctcaggcattctttacacaaaacgggagtaataatgttgttgttgaacgtcaatttagcttcaatattgaaaatgatttagttagtgggtntgatggtataacaaagcttgtttatatcaaatctattcaagatactatcgaagctgtcggtaaagactttaaccaattaaagcaaaatatggctgatacacaaacgttaatagcaaaagtgaatgatagtgcgacaaaaggcattcaacaaatcgaaatcaagcaaaacgaagctatacaagctattactgcgacgcaaactagtgcaacacaagctgttacagctgaagtcggataaantaggtgggaaaaagagcaagcgattggggaccgttttaacgaagtnggacaacaaatcaatgcgcctggccttgtnaaggtaatncaacaacaaattgggaaa

SEQ ID NO: 249 - DNA (Genomic DNA), 1104 bp; single-stranded, linear
cctcagcatatggttgaaccccttcttgataacccatatctgttagttttccccaatgattgctcgcatagctaattgtgccattggaatatcaagtaattttacttaggcacgagaatggtnccgttctactagaacggtgggtttacttctaaaacaatatacaccatcgtgagctataacgaattgaatgttgattaagccaatgatgtttaaacctttagctaattttatagtatagtcctcaagtgttgctaactcgtcttctgtcaaagtttgtggcggatatacagcgattgagtcaccactatgtacaccagcacgttcaatatgttccatgattcctggaataatgaccgtttctccatcacaaatcgcatcaacttcaatttctttaccagttaaatatctatcgactagtaccggatgttccggactcgcttttacagcctgggtcatatagttttctaactctttgtcattgtctacaatttccattgcgcgaccacctaatacataagaaggtcttactacaaccggatatccgatttctgcagcattcgctaatgcttcctcaggtgatgtagctgatttcccttgtggctgtggcacgttaatttttcttaatagtgcttcaaattcttttctatcttcagcacgatttagattttctagtgaagtaccaagtattttaacaccatgtttagccaatttgtctgctaaattaatcgctgtttgtcctccaaattgtacaacgacacctttaggtttttctaaattaatgatattcatcacatcttcttcagttaaaggttcaaagtataatttgtcagaaattgaagaagtctgttgaaactgtttctggattgttattcacaattatcgcttcgtaccctgctttttgaattgcccaaacggcgtgaactgtcgcatagtcaaattctacaccttggccgattcgaattggtccagagcctaatactaagatttctctttgtcagtaactatggattcattttcagtttcgtatgtaccataataatatggtgttgagatcaaatcagctgcgcagtatcaacatctgtaacaggttaatatcatttc

SEQ ID NO: 250 - DNA (Genomic DNA), 1995 bp; single-stranded, linear
ctatcataaaaacataaagtattgtaagctttttatcgatattttttatttataaaaataaaatgagataactntgtgaatttttattgagataaattagatagtgntgtttttgtgatgtttaataatatcttgggtgtgttaatactagtaatgctttcaactgatgcattaagactgtgacatcataactcatttaagaacttcgcttattaattttctaccaatacaatcccttctaagtgcactaaaaaatccttactgctaagtgattaaacttaacaataaggatttatttatcgctaatgcatgattattaacggaatctcataccaccatctacaataattgtttgtccagtaatgtaatcagagtctttaccagctaagaagctcactacatttgaaacatcttctggttgagaaactctgcccaaagcaatctgacttgtaaattgttcccaaccccatgcttcaggtttacctgcttcttcggctgttgccactgcgatactttccatcattggtgtttgaacgataccaggtgcgaatgcattcacagtaataccttcagacgctaaatcttgtgcggctacttgtgttaaacctcgcactgcgaattttgtactgcaatataaagacaagcctgggttaccctcaacgcctgcttgagatgttgcattgataattttaccgccatgattgaattttttaaattgttcatgtgcggcttgaataccccatagcacacctgcaacgttcacgccatatactgttttaaactgttcttcagtaattgtatcgattggtgttgttggtccaaggccggcattgttaaccatgacatggaaatcgccaaattgcgctcggagttgcctgtcttactgcgttaaatacatcatcacggtttgatacatctgctttgatagcaatagcttttgtaccatcacttgataatttaagtgcagctgcttttgccccttcttcattgaaatcaacaactgctactttgaaaccatcttccactaaacgttctgcaattttaaaaccaatcccttgtgctccgccagttactaatgctactttgttgtttgtcataaagatcactcctcaaatttctttcctttaattacattttactcctcttcatttgaatagtacaacaaaggtagctccatttaacaaaatattcagatatttaaggtatagttaaacgcactaccattagtgattggcaatgcgtttaaatgtcgttttaaaagttcttatgttgaatattatttttttaagtctctcgattagtttgtcatcaatcttttttcgagacatgggccttttgattcaatcggcggnttccgtgttatcactgacaactttagttgtagcttcatctttatgtatttcttcgctaaatccttcaaggtttttagtcgtgggatttttaacctcaggatgttccatcatgtctttgactatcaagttcctttttacacgtgtctttatggtgatgcttgatttggcgttcccttttactttttttgaatagtgggtaggtatctgctgcagctactaatttncttcttacccttaaaatagatattggcttggaaacaaaaccagagtatttgcagatacaaagttgcattaatacttaaagcaataatagccaatacaaattaatattgacacctnttgaaatcccttcttttaaattaagtcagatgccaatacgatgacagggtacggattgaaagtataattacaaatatagaaattattgccgatataactattgttactattaaataatcagctctgctacctgataataaatagaaaaggcgaaaattagtccatagcaaattacaaacccacataaagttatagccatgagtactatataagctatttgaaaatataaacctatctttatgaatgattttctacattttttccatgtctatccccattattaatattatacttacctaatata

SEQ ID NO: 251 - DNA (Genomic DNA), 1940 bp; single-stranded, linear
tgtacttgaacactgtactgcggatgagttttttattgacacggaattattagggttcaacggtgacttaccacgtttcgtaattacctccaaacgacagctagtacgtttataagatggtgtatccgtgtattgatcaacatcactattagttaataagttaattgcacctagatctccattttccatcgcatcattatttaatggaatatagatttctttacctttaacacgatctgtcacgtgaacttgtaataccgcttctcctgtttcagaaatcagcttaacttctgcaccttcatgaatgcctctatcttcagcaagctctggagaaatttcaacaaatgcacgtggcactttgtatttaatcattggtgtttgataagtcatattaccttcatggaagtgctctaacaatcgaccattgtttacatgaatatcataaatttcatcttgcttaaagtaattatcaaatgataatgggaataattttgctttaccattatcaaaattgaatccttctaagtatagaataggctcatcagtnccatccngnttgtacttgnccattgtaaactattgaatccttctanncgattcataacttaccccagcatatagaggtgttaagcgtcctaccttcaatccataatttcactaggatgcttgtaattccaatccaaatccctaatctattagcaattgcttggaaaattttccagtcaggttttgaatcaccaagaggttctaatgcttggtataaacgttgaatacgacgttcggtatttgtaaaagtaccgtctttttcaagtgaaggacttgctggcaatacaacatctgcgtatgttgctgtgaatgttaaaaattcatcttggactaccatgaaatctaatttttcaaacgcagcttgtacaaaattaatatttgaatccacaatacccgtatcttcaccatataagtacaatgagtgtacttctccgtcatgtataccttctaccatttcatgattatctttaccagcttttggattcaatttaacgccatattctttttcaaatttagcacgagcgaatatcatccgcttcaatactttgataaccagtaatcttatcaggcatacttcccatatcactacatccttgaacattattatgtccacgtaatggatacgcaccagtaccaggacgacgataattacctgttactaataataagtttgaaatcgctgtacttgagtcactaccaatgtcttgttgtgtaatacccattgcccaacaaattacaacagattcagctttagcacattcttcagcaaatttaatcaattctgattcaggaatacctgttgcttcttcagcaaaagccattgtaaatgtttctaatgatttgtaatattcatcaaaatcatctacccactcatcaataaatgctttatcgtgtaaatcatgatcaataatatacttagtcactgcacttaaccacgctaaatccgtacctggtttaggttgataaaaacgatccgcacgttctgccatttcatgttttctaatatcaaatacatgtattttttgtccaaataatttttgagcacgtttcatgcgtgatgcgataactggatgagcttcggctgtattggtacctatcaatacagacattgccgctttttctaaatcttcaatactacctgagtcaccgccgtgtccaaccgttctaaataagccttttgttgcaggtgcttggcaatatcttgaacagntatcaacgttatttgtgncaataacttggtcttgcttaatttnngggatgnaaatacgattcttccattccggccggttttagaagaaggaaatgaattgatagtgcatcttgggccaatacttnnnctttnaatagatgtaaaattatctgcaaatgacaatttaaaggttccatcccatctt

SEQ ID NO: 252 - DNA (Genomic DNA), 847 bp; single-stranded, linear
gattcaacataacgtcgtgtccttcagcatatatagtatcgaatgctatggacgattaacctgacccagataaacctgtcataacaattaatttatttttaggtagttcggatatcaatatctttcaagttatgcgcacgagcaccttttactactatggatggntctttcatttacttgtcacccntctgcttttaattcaaataacatatctcttaattcngtagctttctcgaaatctaaatctttcgctgcttgtttcatttctttttctatattgtcgattgtctttngacgtgctcttttcggcatcttcttaggtatcacagtttgtgcttngtcatnattttcgtcattttcaacagtagcactaattaaatcatgtacttntttattaattgttttaggtgtaataccatgtttttcattatgtttcatctgtatttctcgacgacgttgtgtctcatcaattgcatacttcatngaatcagtcatattatcggcatacataatganttcacatttatcgntacgctcgtgccgaatcggcacgagctcgtacctattgtttgaattaatgagcggntagaacgtaaaaatccttctttatctgcatctaatatgacaagtagagaaacttctggtatatcaataccctctacttaataaattaatacctacgataacatcatatgtacccattcgtaagtctctaattatttcgattcgttcgtaatgtcttgatttctgaatgcagataattaactttaatacccgcttctttcatgtatgtggttaaatcttcactcatctttttagtgagcgttgtaacaagtacgctcgtgcc

SEQ ID NO: 253 - DNA (Genomic DNA), 1300 bp; single-stranded, linear
ccgcttcgcacgagcnaaggcttttattgcanccctcgcatcttctttagcttacactaaatctttgatgtcttgtaatgcttgtgcaagttgtgctttggcttgttcaatttcttctttagtcatcgcattgttaatgtcgttatgaccttgttgaagtatttgantaattcgatctttaagcgcttgtttntccttatctgttagatttggattgtgatcgatttcgncaattaatgcttgaacttgtttatcaacatcttgtttcgcatcttctttagcttacactaaatctttaatgtcttgtaatgcttgcgcaagttgtgctttagcttgttcaatttcttctttagtcagcgcattgttaatgtcgttatgaccttgttgaagtatttgattaatacgatcttttaagtgcttgtttttccttatctgttagatttggatttcgatcaatttcgtcaattaatgcttgaacttgcttatcaacgtctttattggcatcaattttngctttnggtatttcattagcangcactngttcaatcgcgtggttgcctgctgtttgaacttgagatacagcctgattacttgttgctttattaatgttgttgatgatgctggtttgccaattcttcttgctttattttttcggcaataagcttgtcttgatccgtcgcatttgaagcttcgatttcttttagcttattagctaaagcttgattaattgattgaattgccttgtctttagcatcttgtagtcgttgatcaccattaagattatggattgcatcattgactgcttggattgcgccattgatatcattcacatttgtgttatcactatttagcaatgtatttgctagacgtttggcatcatcgaagtttgttttagcattatcgtcagcgttttggtaattgacagtttgctctgcatttggaatttcattgtcaactaaatgtttcaatgtttccattgcatcatttaagtcaatttgattattaacaatatctgttacatctgatacagtatcggcattgttaattgctttatgtgcaagatcttgttgctgttgatttaatccatttaacgaattaacaaacgcatttgctttatcctttggcatttgcaaggttttggtctccatttaatgcattttgagcatcgataatattttgtttcaattgctctgcttcagcttttgcaattgcattacttgcactttatctaactcatgtgctgcattcgcaatgcatatcataatttgctttcaatgtcatctgcatgatgtattgtgct

SEQ ID NO: 254 - DNA (Genomic DNA), 1425 bp; single-stranded, linear
cttttcatctcttcgacctgtgtaatacctttgatcagctgcacaaatagacaagtataaaggtcttacgatgacatgattaccataaatatcaacattattatatgtgacgtcgaactgtctcggtgcaacgagttgatatacttgattaatcatcggcaatatcaccttgaataatggnatttgctactttnaantcatncggggttgtcactttaatgttgtatagttctccacgtaccaatttaactgcatgtccagattcgacaattattttacatgcatctgataagatttctttntggttcactacttaaggcgcgataactatcttgtaataatttaatattaaatgattgtggtgtttggccttgatacatttcattccttacagggatactgtgtatgttctgtttatctttagacattacaatcgtatcaattgcttcaatgactgtatctactgcaccatattnngctgctacttcaatgttctctttaataatacgttgagttaaaaatggtcttacggcatcatgagttacaatcacatcatcattattaattccatttacattgcgaatatggtcgataatgttcataattgtttcgtttcgatccgnaccacctgcaactactttgacacgttgatctgtaatgttatatttttttaaaatatcctgtgtatgggaaatccactgtgctggcgttgcgataataatctcattaaattcactcactaaaatgaacttctcaattgtatggattaaaatcggtttattatcaatatctaaaaattgttttgggtaatggcacgttccccattctcgaaccaatacctcctgctaaaatacctgcataaatcatgttggcctccatcctgtcattacatcatttccatttatacattactgacctatgcccgcacataagcctaacctattgctcactngnctcttntattaatccaaagatagttgtcacaatagtgtgataattntttataaaaatgtatttntgnnactgaccantctaagttgttttggcatgcagctaatcattaactctgacgatattaaattgttaaaggtattaatgtttactctttcacaaattcattattactgccatcatttnnccatatattataataaatttatcttattaagtggctgnacttgattttcactttaaaaattatcaaatattgccatctcattttaagnatacaaaatgcaaaacaaccgattcacaagcatatttcacacaagtaaaccggctatttatcaacgtatattcgaagatgaattatttcgatagtatcttgtagaccagncggcattcgcactttcaatagcntattaacttataccagnggtttcgtcctcnanggtgcatactaataaatcgtaaacntgactttag

SEQ ID NO: 255 - DNA (Genomic DNA), 3160 bp; single-stranded, linear
tttcttacctttaataattggtaattcatcttccatcctcttgtttgatctgtgtcgcataagcttcatcaaatagtacatcagtacgtggaacacctgtaggcactacatttttctctttaataccaaatgcttcagcgtagaatggaatatcggtttcagatgatacataagctttggcacgagctacgatgatttaatgaatcaataaatggtccaccctttttaccagtacgactaaagccaactgttttaaaggcaccaacggcatgccatacttgaataacttcttgagaacgtctaaaacgcactgtataaatcaaggggtgaaagtcatcaacaaagatgtagtctgccttcccaagtaaatatggcaatctaaacttgtcgatgatgccacgtctatctgtaatattcgctttaaaaacagtgtgaatatcatactttttatctaaattttgacgtaacatttcgttatagatgtattcaaagtttccagacatcgttggtctagagtctgatgtgaacaacaccgtattcccttttttcaagggtgaaaaatttcgtcgtattaaatatcgcntnaaaaataaattgtctttgttattaaatgaatgtttgcggaaatacntacgtaattctttaatatttacgaacgaaaataaatacttttaacttccggagtcgttacnaccaacatcaaggacaaattcattaacattcgcnagaaatttcagggtgtaacagtataaaccgttttcttcgaaatgccgccttttctaaattcttttaggtaagtctgcaataagaaattgattttaccattttgtgtttctaattcgttgtattcttcttcttgttctggctttagattttgatatgcatcattaatcacatctgggtttanctgtgcaatataatcaagttcttgctcattcactaataagtacttatcttcaggtaagtaataaccattatctaagatagctacattgaaacgacaaacgaattgattcccatctattttgacatcattcgccttcattgtacgtgtctcagttaaatttcttaatacaaaattactatcttctaaatctaggttttcactatgtccttcaacgaataactgaacacgttcccaatagattttatctatatatatcttacttttanccaacgttaattcatccttttctatttacataatccattttaatactgttttaccccaagatgtagacaggtctgcttcaaaagcttctgtaagatcatnaattgttgcaatttcatattcttgaccttttaacaacgctaatttatctacaatatctgggtattgaatgtataagtctacaacatcttggaaatcttgtgacccacttcgactactaccaatcaacgttagtcctttttccaatactagacgtgtattaacttctactgggaactcacttacacctaacagtgcaatgcttccttctggtgaaatatantcaatcatttgatttattgctgattggntaccacgcccaccaacgcactcaaatgcatgatcanatgttaagccttcaggtattttattaataaagaagacatcatcaacaaatgagaagtgactcaatttataatcttggtnnaccaaagacatatatggnagacttctggatattaatngacggaataaaatggctgtaatgtaacctaagttaccatcaccccaaataccaaatgtatttttatttgaaatagatttcttttcaacaacgacgaatagcatgcaaacttactgttacaagctctgtagatgaaataatacttaaatcaatatcatcaggtagtggtacagctctatcatgatttagcaacacaaaatcttgcataaacccatcatgtccacttgatctgaagtagctcgattttaaatagttttcagcaatgacatcgtctttttctgtcggcgtattcggtaccataactacttttgtacctttattaaacacacctttactgtcaaatacgacctcaccaacaccttcatgaattaaagacattggcaatttctgagataagacattctcatcacggctaccagtataatatctttgatcggcagcacaaattgacatatataaaggacgtacaatgacatagtcactgtaaatatctacgttgttatacgtaacttcaaattgtctaggtgcaactaattgatatacttgattaatcatcggccaataccacctcgaataatagcattcgctacttttaaatcgtaaggtgttgttactttaatgttatataactcaccttttacaagtcgaaccggtttgtttgtttctacaataatcttacaagcatcagataaaatactcttttgctcatcactcaactgtgcatagctttcttttaataaattaatattaaacgattgaggtgtttgaccttggtacatttcattacgcactggaattgcatcaatcgtttgattatctttagatgtaacaatcgtatctatagcatcaatcactgtatctactgcaccgtactctaaagcagcttgaatattttctttaataatacgatgcgttaaaaatggtctaactgcatcatgtgtcacaatgacatcgtcatcgttaataccatttgttgattcaatatgtttaacgatattcataattgtatcgttacgatcgctaccaccttgaatgacttcaattctttcatcagaaattttgaattttctaagtgtatctttcgtatgcgtcatccattgttgtggcgtcgcgataataattttttcaaaatcattaattaaaataaatttttcttaatgtatggattaaaatcggnttgttgtctaaatctaaaaatngtttaggtaaagggtacggttacccattccttgagcctatacctccagctagaataccagcgtatttcataaaatacttcctccattcaactatatctatatttaattatttaaatttcgttgcattttccaattgaaaactcattttaaaatcaaaactctaaatgtctgtgtattacttaaaattatacatattttgcttatattttagcatattttgtttaaacctatattacattatatcagacgttttcatacacaaataataacatacaagcaaacatttcg

SEQ ID NO: 256 - DNA (Genomic DNA), 1676 bp; single-stranded, linear
aaaaaaacaatttancccatnacnacttgtcgttaattattcatacgaaatacatgattaatgtaccactttaacataacaaaaaatcgttatccattcataacgtatgtgtttacacatttatgaattagataacgattggatcgattattttattttacaaaatgacaattcagttggaaggtgattgcttttgattgaatcgccttatgcatgaaaaatcaaaaggttattctcattgtatagtcctgcttctcatcatgacatgttgctcacttcattgtcagaacccttcttgaaaactatgccttatgactcatttgcatggcaagtaatatatgccaacattagcgtctaaacaaatcttngactaaacgttcactngagcgaccatctggatatttaaaangtttagctaagaatggtacaactttttcaacctcataatcttcagtgtccaaagcatccattaatgcatcaaaggattgtacaattttacctggaacaaatgatccatatggttcatagaaatcacgcgtcgtaatgtaatcttctaagtcaaatgcatagaaaatcatcggctttttaaatactgcatattcatatattaaagatgaataatcactaatcaacaagtctgtaacaaagagaatatcgttaacttcacgatgatctgacacatcgataaagtattgtctatgttcacgtgaaatattaagtctattttttacgaacggatgnattttgaataacacaactgnattatgcttctcgcaggatcttgctaaacgttcaaaatcaattttaaaaaatggataatgtgccgtaccgtgaccattacctctaaatgtcggtgcgaatagaataactttcttaccttttataattggcaattcatcttccatctcttgtttaatttgtgttgcataagcttcatcaaatagtacatcagtacgtggtacacctgttggtacaacattttcttctctaattccaaatgcttcagcataaaatggaatatcgggtttctgatgaaacatatgctttcggtgtaactacgatgggttttaatgaatcgataaacggaccacctttttnacctgtacgactaaagccaactgttttaaaggcaccaacagcatgncacacttgaataatttcttgtgatggtctaaagcgaaccgtataaattaatggatggaaatcatcaacaaaaatataatcggccttaccaagtaaatatggcaatctaaacttgtctctccatttgcgtctatccgtaatattcgccttaaataccgttttaatatcataatcaaaatctactttgtggcgtagtaactcatcatatacatacttgaaattccctgataaattcggacgcgaatctgatgtgaataatattgttntgcttcttttaatatgtagtaactttgtaatattaaaaatagctttaaataagaaacttctactttcaaatgaagctttatgaccttgtttatgaagccagtgtgcacttggcgcaatgaccctgatttctcttgaggtaaggtgatttcaatatcaaatacaaattcggntaaccgtcacttggctatctccggagtaatggtattagaccgtatgttgtgatacgccacctttacggaaaactttagcatcatacgctaataaag

SEQ ID NO: 257 - DNA (Genomic DNA), 3110 bp; single-stranded, linear
gattcgagctcggtaccggggatcctctagagtcgacctgcaagctataccaagctagagtactgcgacgcaaactagtgcaacacctaaggctgttacagcttggaagtcgataaaatagttgaaaaagagcaagcgatttttgaacgtgttaacgaagttgaacaacaaatcaatggcgctgaccttgttaaaggtaattcaacaacaaattggcaaaagtctaaacttacagatgattacggtaaagcaatcgaatcgtctgagcagtccatagatagcgttttaagcacagttaacacatctaggattattcatattactaatgcaacagatgcgccagaaaagacggatataggcacgttagagaagcctggacaagatggtgttgatgacggttcttcgttcgatgaatcaacttatacatcaagcaaatctggtgtgttagttgtttatgttgttgataataatactgctcggtgcaacatggtacccagacgattcaaacgatgagttcacaaaatacaaantcttacggcacatggtacccgttttattaaaaagaatgatggaaacttaactagcaatttggttggaggaacgtcttacaacgctttaaatcaagctaagcagtatgtagatgataaattcggaacaacgagctggcaacaacataagatgacagagccgaacggtcaatcaattcaagttaacttaaataatgcgcaaggcgatttgggatatttaactgctggtaattactatgcaacaagagtgccggatttaccaggtagcgttgaaagttatgagggttatttatcggtattcgttaaagatgatacaaacaagctatttaacttcacaccttataactctaaaaagatttacacacgatcaatcacaaacggaagacttgagcaacagtggacagttcctaatgaacataagtcaacggtattgttcgacggtggagcaaatggtgtaggtacaacaatcaatctaactgaaccgtacacaaactattctattttgttggtaagtggaacttatccaggtggcgttattgagggattcggactaaccgcattacctaatgcaattcaattaaccaaaccgaatgtagttgactcagacggtancggtggcggtatttatgagtgtttactatcaaaaacaagtagtacccactttaagaatagacaacgatgtgtatttcgatttaggcaaaacatcaggttctggaacgaatgccaacaaagttactataactaaaattatggggtggaaataatgaaaataacagtaaacgataaaaacgaagttatcggatacgttaatactggcggtttacgcaatagtttagatgtagatgataacaatgtgcctatcaaattcaaagaagagtttgaacctagaaagtttgttttcactaacggcgaaattaaatataacagcaattttgaaaaagaagacgtaccgaatgcatcaagccaacaaagtgaatcagatttgagtgatgaagaacttcgcggaatggttgcgagtatgcaaatgcaggtggcacaagtaaacgtattaacaatggaattagctcaacaaaacgctatgttaacacaacagttgactgaactgaaaactaacaaaacaagtactgagggggacgtttaatgatgaagatgatttatccgacttttaaagacatcaaaactttttatgtttggggttactataaaaacgagcaaattaagtggtacgtagacaagggtttaatcgataaagaagaatacgctttaatcactggagaaaaatatccagaaacaaaagatgaaaagtcacaggtgtaatgcttgtggctttttaatttaacaaaaagtaggtggcgtaatgtttggttttaccaaacgacatgaacaagattggcgtttaacgcgattagaagaaaatgataagactatgtttgaaaaattcgacagaatagaagatagtcttagagcgcaagaaaagatttatgacaaattagatagaaattttggaagaattaaagcgcgacaaggtagaagatgaaaagaataaagaaaagaatgccaagaatattagagacataaaaatgtggattctcggtttgatagggactatcttcagtacgattgtcatagctttactaagaactatttttggtatttaaaggaggtgattaccatgcttaaaggggattttaggatatagctnctgggcggtcctcctggttgggggtaaatgtaaataacagttaagagtcagtgctccggcactggctttttattttgattgaaatgaggtgcatacatgggattacctaatccaaagactagaaagcctacagctagtgaagtggtggagtgggcaaagtcgaatattggtaagaggattaatatagataattatcggggcagtcaatgttgggatacacctaactttatttttaaaagatattggggttttgtaacatggggcaatgctaaggatatggctaattacagatatcctaagggtttccgattctatcgttattcatctggatttgttccggaacccggagacatagcagtttggcaccctggcaacggaataggttcggacggacacaccgcaatagtagtaggaccatctaataaaagttatttttatagcgttgaccaaaactgggttaattctaatagttggacaggttctccaggaagattagtaagacacccttatgtaagtgttacaggctttgttaggcctccgtactcaaaagatactagcaaacctagtagtactgatacaagttcagcatcaaaaagccaatgactcaacaattactggcgaagcgaagaaaccgcaatttaaagaagttaaaacagtaaaatacactgcttacagcaatgtttagataaagaagagcacttcattgatcatatagttgtaatgggtgatgaacgctcagatattcaaggattatatataaaagaatcaatgcatatgcgttctgtagacgaactttatacgcaaagaaataagtttataagcgattatgaaataccgcatttatatgtcgatagagaggctacaggaattccggaattccg

SEQ ID NO: 258 - DNA (Genomic DNA), 2553 bp; single-stranded, linear
aaattatatataataacgtcgttttaactaaggcaacataaggaggtgcgtcaattggctcaagcaaaaaagaaatcgacagctaagaaaaaaacagcatcaaaaaaaagaacaaattcaaggaaaaagaagaatgataatccgatacgttatgtcatagctattttagtagttgtattaatggtgttgggtgttttccaattaggaataatcggtcgtctaattgacagcttctttaattatttatttgggtacagtagatatttaacatatattttagtactcttagcaactggttttattacatactctaaacgtattcctaaaactagacgaacggctggttcgattgtattgcaaattgcattgctatttgtatcacagttagtttttcattttaatagtggtatcaaagctgaaagagaacctgtactttcttatgtatatcagtcataccaacacagtcattttccaaattttggtggcggtgtattaggtttttatttattagagttaagcgtacctttaatttcattatttggtgtatgtattattactattttattattatgctcaagtgttattttattaacaaaccatcaacatcgtgatgttgcaaaagttgcactggaaaatataaaagcttggtttggttcatttaatgaaaaaatgtcggaaagaaaccaagaaaaacaattgaagcgtgaagaaaaagcgagacttaaagaagaacaaaaggcacgtcaaaatgaacagccacaaataaaagatgtgagtgattttacggaagtgcctcaagaaagagatattccaatttatgggcatactgaaaatgaaagtaaaagccagtgtcaaccaagtcgaaaaaaacgagtgtttgatgcagagaatagttcgaataacatcgtaaatcatcaagcagatcagcaagagcaattaacagaacaaactcataacagtgttgaaagtgaaaacactattgaagaagctggtgaagttacgaatgtatcgtatgttgttccaccgttaactttacttaatcaacctgcaaaacaaaaagcaacatctaaagctgaagtacaacgtaaaggacaagtaccaaagagatacatnaaaagattttggggtnaaatccnaaagtngacacaaatnaaattgtcctncagtaactcaatatgaaatcccacccagctcaangggggttnaaagtgagtaaaattgtaaactttgcataatgatattgcattagctttagcaccaaaagatgttagaatcgaagcaccaatacctggtcgctctgcagtaggtattgaagtgccaaatgagaaaatttcattagtttcactaaaagaagttttagatgaaaaattcccgtctaataataaactagaagttggattaggaagagatatatcaggtgatccaattactgttccactaaatgaaatgccacacttattggtggcaggatcgacgggtagtggtaaatctgtttgtataaatggtattattacaagtattttattaaatgctaagccgcatgaagttaaacttatgttaatcgatccgaaaatggttgaactaaatgtttataacgnnnnnncacatttattaattccggttgttacaaatcctcataaagctgctcaagctttagaaaaaattgtagctgagatggaaagacgttatgatttattccaacattcatcaactagaaatattaaaggttataacgaattaatccgtaagcaaaatcaagaattagatgagaagcaaccagaattaccttatatcgttgttattgtagatgagcttgcagatttaatgatggtagctggtaaagaagttgaaaatgcgattcaacgtatcacacaaatggcacgtgcagcaggtatacatttgattgtagcaacacaaagaccttctgtggatgtaattacaggtatcattaaaaataacattccatctagaattgcttttgctgtgagttctcaaacagattcaagaactattattggtactggcggcgcagaaaagttacttggtaaagggtgacatgttatacgttggaaatggtgattcatcacaaacacgtattccaaggggcgtttttaagtgaccaagaggtgcaagatgttgtaaattatgtagtagaacaacaacaggcaaattatgtaaaagaaatggaaccagatgcaccagtggataaatcggaaatgaaaagtgaagatgctttatatgatgaagcgtatttgtttgttgttgaacaacaaaaggcaagtacatcattgttacaacgccaatttagaattggttataatagagcatctaggttgatggatgatttagaacgcaatcaggtaatcggtccacaaaaaggaagcaagcctagacaagttttaatagatcttaataatgacgaggtgtaaaaaatttgattaagcaaaataaattggaatatggtgaccaactatccaagtaatttatcaattgccagagaattaaatgtaaaaaccgacgatgtttatgaagcaattcaggcattgattactg

SEQ ID NO: 259 - DNA (Genomic DNA), 1664 bp; single-stranded, linear
ccgtacattaacaacctggattaattacagattacgttttgtctcatctaaaaattgttgataatctttgatcaatttccaaatctgtacgtatgtattatcttagtagtagtttaatatgcactaaatacttgcaattgatatttaccatatttattgtcaaatccaattatcttgtgtttttcataaaacgattgctttaaataatcttctaacacatcaaacatcgtattatcaccgacatggtgcccgtataaaatagtattatgatttaaattctncaattcatttctaaaatccataaaaatactacctttacgtcgatgttctcgctcaaaatctaaatttaaataatcgtgatttgtcttaccttgtagtactggataanttaatgatgttcctgataattttatccatccaacaatgtctttatttattttttcaagtgattcaaattgtggtctcacatgttcttgatgtttgntcatcagcatntgaaatttntgttgtaatttctcataanttgcgcgttcttgcttgtcttcaatatatgtttgaacaattttgtaaccaaaaatgataataattacaaccaataaaatttgtacaatagttaaaaatcgcttcattctcataaaaaccctctttaataaacaantttcttcagtcatcactaaaccagttgttgtaccgttttagattcgatttcgttgactttgacaaattaagtaaattagcattggaccaccgacaatcattaaaatagcattggctggaatttctaaaggaggctgtatcactcgtcctaataaatcagccactaacaatagccatgcaccaataactgtagaaaacggaataagtactctgtaattgcccccaactagctttctaaccacatgtggcacaataatacctaaaaaggctagttgtccaacaatcgcaacagttgcacttgctaaaaatactgctaataaacctgttaaccatctgtaacgatcaatattaaaaccgatacttcgcgcttgtatgtcgtctaaatttagtaaattcaatttaggggacaatagtaatgttaatattaatcccaataatgctgatactgctaatatgtatacgtcgctccatattttcattgttaagccttgaggaattttcattaaagggttttgagttaaaatttctaaaacaccatttaataatacgnataacgcaacacctactaatatcatacttacagcattgaatctaaatttagaatgcaacaatataattattaaaaatggtattaaacctccaataaaacttaataatggtaagtaaaagtacaattgtggaataaacaacataccaagtgctctcattataagtgcacctgaggaaacgccaatgatattcgcctctgccaaaggattttgtagtcctgcttgtaataatgctccagaaactgctaacattgcgccanccatcaatgcaantaatagacgtgccaatcccaaatcaatgattgaatccactgcttcattgctaccagttgtaaattttgtaaataggtcattaaatgacaatttaattgtaccggttacaaacgaaatataagcagttgcgattaaaatgactaacaaacataaaaatagtagtttctttttattttttatcatcag

SEQ ID NO: 260 - protein, 50 aa
VLHXIREILLQLVHHSDXGXGIQPPKFFQPGDXXKVTIDNIGTLTTYIXK

SEQ ID NO: 261 - protein, 51 aa
VPIKAVIAQTMTTLPRVINIKRLTSGLNKPLSFMMPKKIMAXINIITTXMX

SEQ ID NO: 262 - protein, 90 aa
VIKFKNVTKRYGKHVAVDNISFNINEGEFFVLIGPSGCGKTTTLKMINRLIHLSEGYIYFKDKPISDYPVLRNALGYWXRXGXRLELXPI

SEQ ID NO: 263 - protein, 90 aa
VCCFGASTMLSHITAYEILSEIXKKLAQKLMRLPLXVVESKKIGELKNIFXDKVETIELPLAHMIPEVXGNLLVAAAIFLYIMXXDWRIG

SEQ ID NO: 264 - protein, 152 aa
VTSFIYKILYVVKINAYTYDIMTEDIMXLSILLIFLCIRLVSLKICIXHSKQLKADGAVEYGVKNSKFLAITHVLIYVLAGVEAFINKDTFSFANGIGLVILIFAYIMLFMVIKTLGGIWTLKLFILPNHPIIKSGLYKITKTPKLLLKHHS

SEQ ID NO: 265 - protein, 104 aa
VRVTGIXPYGAFVETPNHTEGLIHISEIMDDYVHNLKKFLSEGQIVKAKIXSIDDEGKLNLSLXDNDYFKNYERKKEKQSVLDEIRXTEKYGXQTLKRTLTNLG

SEQ ID NO: 266 - protein, 97 aa
VTXGVXELIIXSGEEESSSQLCHPHSVKDVTGAGDSFCAAVVYSWXNGMSTVDILIAGMVNAXKTIETKYTVRHNLDQQQLYHDMEDYKNGKFTQVY

SEQ ID NO: 267 - protein, 56 aa
VNKNXTTMSHITXXQSAILASKVNAPSVYNXNNMSENFTQRVKHXLRKNEATTXYQ

SEQ ID NO: 268 - protein, 54 aa
VSSRDIGEHVMNLLMHVDQVSYVRFASVYKEFKDVDQLLASMQGILSENKRSDA

SEQ ID NO: 269 - protein, 104 aa
VAXVXIIXFMMLXPXGGFIALEQIGERMNIAAIEVDKSYRFNGIGSSALRQLPTYLRKNYDNLNVITMILFGENNDFKPLCLNSNFVEIEQTDDYVVFEKYLNY

SEQ ID NO: 270 - protein, 90 aa
VEIKVHALHSGITLIKDKGKIIDIHLSVKATENIDGEVLFKATQPLGRTMKVGVQNNAMTITLTKQNQWLDSLKFLVKCIEESMRISDEA

SEQ ID NO: 271 - protein, 114 aa
VEYFVSYYDYYQPEAYVPSTDTFIEKDASINDEIDXXRHSATSALFERDDVIIIASVSCIYGLGNPEEYKDLVVSVRVGMEMDRSELLRKLVDVQYTRNDIDFPTRNRFECVVM

SEQ ID NO: 272 - protein, 52 aa
VGHILIEISXDGPGFMEDXPYETLGXGLSLPPFLENKREYIESEIRPFNTKR

SEQ ID NO: 273 - protein, 46 aa
VSITLXPALAATLFKKGVKRRNKQHQEGLGVVSTTYKXVXHWVTKS

SEQ ID NO: 274 - protein, 45 aa
VVQETLNMSKARGYEVGGTVRIVINNQVGFTTSNPLDARSYAVLY

SEQ ID NO: 275 - protein, 88 aa
VEGNFGLAINNHQNIVGTIGLIRLDNNMSALKKMFVDKGYRNLKIGKKLLDKVIMTCKEQNIDXXYLGTXDKXXSAQYXYXNXGFRXN

SEQ ID NO: 276 - protein, 96 aa
VIGLKSKTIISNEWGAIMIQSMWFNLHVQDLEKSAQFYKALGFKINRNPQMLDKMVGIQIGQTTAILIENKHFQNVSQQSLNTEPNEVMISLGVTQ

SEQ ID NO: 277 - protein, 85 aa
VSLMTTFSEKEKIQLLADIVELQTENNNEIDVCNYLKDLFDKYDIKSEILKVNEHRANIVAEIGNXSPILALSGHMDVVGCRKSR

SEQ ID NO: 278 - protein, 66 aa
VEXMNKHYXIVIIGGGTAGVTVASRLLRKNXNLKEKIAIIDPADHHYYQPLWTLVGAGVSSLKSXS

SEQ ID NO: 279 - protein, 61 aa
VLRNKIKRAIRENFKVHKSXILXKDIIXIXRQAAKDMTTLQIQXSLEHXLKIGKVFNKKIK

SEQ ID NO: 280 - protein, 71 aa
VDGVSLAVFDKHDNSFDIHLIPETRRSTILSSTKLGDKVHLETDVLFKYVENILNKDKDQLSVDKLRAFXF

SEQ ID NO: 281 - protein, 126 aa
VXQSLYEFLEENINYLKENGXYNEIDTIEGANGPEIKINGKSYINLSSXNYLGLATNEDXRSAAKAAIDTHGVGAGAXRTXNGTLDLHDELEETLAKFXGTEAAIAYQXRIXLXIWLLXQLVXEXK

SEQ ID NO: 282 - protein, 51 aa
VLGGNVTETHTFKLPEDAGERQMFIIDKKRQTPKKYPRKPGTPNKTPLLEK

SEQ ID NO: 283 - protein, 32 aa
VKENDVKKFKYKNFXDEIEIDFTDSNHLAAHR

SEQ ID NO: 284 - protein, 76 aa
VTPDANGKVAFDGLELTFTGTPAVNDSFTLKPVSDAIVNMDVLITDEAKIAMASEEDAGDSDNRNGQALLDLAKQQ

SEQ ID NO: 285 - protein, 73 aa
VLLPLVFISVLIGIFNYIKVLPFIIKYVGIAINKITRMGRLESYFAISTAMFGQPEVYLTIKDIIPRLSRAKL

SEQ ID NO: 286 - protein, 54 aa
VIISNNVGDMSIGFSSDDNELTMHFRNNEKVNIKKGKKVVLAAQILDELETRWQ

SEQ ID NO: 287 - protein, 88 aa
VTYXHMSHRHTLISHSFKFXRLPQDINFFSWXQHVKDSDKTDELTYSESLXPEGHPTHPLTPTKLPXTMEEXRAYAPEFDXRNPFATL

SEQ ID NO: 288 - protein, 70 aa
VISLLKDAKLPSSVTRGDYLAILSXGAYHYSMXSNYNHMHKPSVFFLKDVTARVVIKRQSLRQLIINXTQ

SEQ ID NO: 289 - protein, 67 aa
VQFVNKLFNVSSAIILLEYDGVVHIGYDNNFEFKTEQFKMSKSRNLLKNRSQNXVLIRLLNWLRTTX

SEQ ID NO: 290 - protein, 41 aa
VQLGLTNSVVAIIIIXREXAVTGLRLLQIEQGXGKCSWXIR

SEQ ID NO: 291 - protein, 66 aa
VDVDNMSDYKLKIIXLTXSDITGYQIPNQXGVAQYVISQLSQGKREVDNLTLNXXEXLYSYXRQVL

SEQ ID NO: 292 - protein, 40 aa
VKQTXVEEIXASINXAGLXXEIPDFKXEVXXXXKKWRLCY

SEQ ID NO: 293 - protein, 106 aa
VSTDFILCKLQAFHIIKFEKRYIEVEKNEYTAKYNEYSQLLDATYSQAVAYLLNKYGAVTDDYYKEKSYTRFLNGEIKSISKGKYTRASEGLYCHHISEDKFQNLS

SEQ ID NO: 294 - protein, 86 aa
VILSSIXFYMQLLQKNPMAIGVWAGLCQMIKPTVIDWDISEYTPKPAWMQATKARAYVPRILVEKLLIXIDDMLEGIEIYDXXESR

SEQ ID NO: 295 - protein, 82 aa
VXTYVNDYLNEAHITNKWSEMMLWSSQQRSQYTVQLINKIETDDSYIHISKGELGISLMPHIQLKKAMSNTASHIEDLSCGL

SEQ ID NO: 296 - protein, 59 aa
VCKKYVLGQFKPGMTAPQCAGIIHTDFXRGFIRAGSNKLLMTMYNMAAKVALKKRADTD

SEQ ID NO: 297 - protein, 56 aa
VLTLAEMKRTIHDILDFRDEDIWXCYLGTLAVSPXLXDDXGXXLLSRXXNAYNXYX

SEQ ID NO: 298 - protein, 98 aa
VFNYGQSVFEGLKAYKRDGEGCTXPXPEENFKRLNNSLARLEMPQVDDAELLEGLKXLVDIERDXXPEGEGQSLYXXPFGXATEGAXGVGASHQYXIY

SEQ ID NO: 299 - protein, 47 aa
VRFILEDPPRDLDIYIDIAERAGQHPXVERIXDGXQRRIDIXTVESC

SEQ ID NO: 300 - protein, 123 aa
VVKTRILKVDNPEITIPLKPTGSHFQQCVWNELRQVPYGTLTTYGAIATKVGKVLDKPQMSAQAVGGAVGSNPLSIIVPCHRVVGKTGSLTGFGGTINNKIKLLELENIDMSKLYIPKHSTKP

SEQ ID NO: 301 - protein, 62 aa
VCLVECMMALNTAGXTQRTVETLAEYSGVPVWNGLTDEDHPTQXLADFLTAKEVFKKRLCRY

SEQ ID NO: 302 - protein, 88 aa
VNLPDFPPKIGVNKSTLSRYXXGSRXIPMEDIAEIANALKVTPEYLLLXNRQPEXEVQHRAAHLEGELTDDECQRVLDYADYIRSKRK

SEQ ID NO: 303 - protein, 121 aa
VKPXCAKKDRYPIDPMRRLNQEIIDYIDTLNYIDQYSSAGSFRRFKEMSKDLDFIISTDNPQAVQQQLLNIPNKVKEVAVGNTQVSLELAYDDETIGVDFRLIEPRAFYHTLQHFTGSNRT

SEQ ID NO: 304 - protein, 116 aa
VFDIYSEXDLIEITDYPXSISFNFASYMSASKFFKDYALXTNDKSQYLEDYNQHVAIVALYLAXGNKAQAKQFISAMVEQRYXPATPTFLNAXRARRGELVSCFXXKKWVXXLNSX

SEQ ID NO: 305 - protein, 266 aa
VMEVTCLKQITWHDLQHIIKDGDVIGLPALAVANLPAEVLRAVLAQHDTYHTPKDLTFILANDIHSLGAAPDLDDFIERRMIKRVIMSILTASSKTAQAMKNNDIEAYFLPQGIIATHYRQSNQLLPGVITKIGLNTAVDPRYGGGKVNTRTTDDLVSLVTINDETYLHYTFPSVDVALLRGTYADQQGNIYLXQEAYLSECYHVALNAKANHGKVIXQVKALVDDYHLKPNEVVIPGNLVDYVFVTEDEKNHRQVIQSHYLPALS

SEQ ID NO: 306 - protein, 68 aa
VVKIVXHQKDSNXEKDDKARTXQQDXKXXDSSXDKKDNXDDSXDVXKDNKDNSANDNQQQSNSKCNKQ

SEQ ID NO: 307 - protein, 171 aa
VRRFPDIERRVQTHDFTWQAEIMSKPVKNMTVAIIGTGRIGAATAKIYAGFGATITAYDAYPNKDLDFLTYKDSVKEAIKDADIISLHVPANKESYHLFDKAMFDHVKKGAILVNAARGAVINTPDLXAAVNDGTLLGAAIDTYENEAAYFTNDWTNKDIDDKTLLELIGT

SEQ ID NO: 308 - protein, 52 aa
VVVLMCCLKYENDYYEEVRAQLPDIGEAIETPDGNRESSCFKYIRHFYAGEA

SEQ ID NO: 309 - protein, 114 aa
VNTXLLNXRVEPAIVKIPVSVDENIDNVEKKLNTLFTILCVVNXXLFVSDPVVIGIDAFEDTRVILXVSAETIPGXGFSGARIIRKEVHKMFLQEGIKTPXPIMTPFNHSEXGV

SEQ ID NO: 310 - protein, 44 aa
VTQLLKNAXKKXNDLIKEEAEIVKNDDLPXXLIIXGXQYDXRWR

SEQ ID NO: 311 - protein, 119 aa
VRFHDGXTFDADAVKKNIDAXQQNKKLHSWLKISTLIDNVKVKDKYTVELNLKEAYQPALAELAMPRPYVFVSPKDFKNGTTKDGVKKFDGTGPFKLGEHKKDESADFNKNDQYWGEKS

SEQ ID NO: 312 - protein, 307 aa
VPIDYIXQTGDIVEIRTSKHSYGPSRDWLXIVKSSSAKGKIKSFFXXQDRSSNIEKARMMVEVEIKDQGFRVEDILTEKNIQVVNXKYNFXNEDDLFAAVGFGGVTSLQIVNKLTERQRILDKQRALNEAQEVTKSLPIKDNIITDSGVYVEGLENVLIKLXKCCNPIPGDDIVGYITKGHGTKVHRTDCPNIKNETERLINVEWVKXKDATQKYQVDLEVTAYDRNGLLNEVLQAVSSTXGNLIKVSGRSDIDXNXIINISVMVKNVNDVYRVVEKTKQLGDVYTGNKSLGTRGSKNIESRWYKRG

SEQ ID NO: 313 - protein, 92 aa
VSTVHPIRIPPGDPVSTVDIVIGRVAQVHIADXVILDNGKLDIKSIKPIARLGYSDYTVVNEIFEMKAPXASKEELAGLEGRNFDNQSDEKR

SEQ ID NO: 314 - protein, 99 aa
VLTRLKTMGKLAMLMLKDLDQAFKKKDTVLIREIIERDEDIDDLYSHIINATYLIDNDPFVAAQAHLAARHLERIGDHIINIAESVYFYLTGTHYEQIT

SEQ ID NO: 315 - protein, 95 aa
VTNKILSQFLNIKPPSVSEMVGRLEKAGYVETKPYKGVRLTEDGLTHTLDIIKRHRLLELFLIEILKYNWEEVHQEAEILEHRISDLFVERLDSC

SEQ ID NO: 316 - protein, 40 aa
VSGNXXQADLIGYSFKFDGAIXRQEASXDVHAVILSNKTL

SEQ ID NO: 317 - protein, 75 aa
VVSMKYNTNVKHTTLEAFVTTVNDLGIELIINEALREVRKRQLIELIDDALVNKDEAAFNQYTAEYKNLEAFLGX

SEQ ID NO: 318 - protein, 97 aa
VYKVKVAVIMGSSSDWKIMQESCNMLDYLEIPYEKQVVSAHRTPKMMVQFASEARERGINIIIAGAGGAXHLPGMVASLTTLPVIGVPIETXKFKGY

SEQ ID NO: 319 - protein, 42 aa
VKKIDCSXIGICGYEYRQLKQETXLXLFXKLHPSFXGQGVRM

SEQ ID NO: 320 - protein, 54 aa
VLGLIEGKSQRKAYIDAGYSTKGKSDNYIDSRAFELSKNSAGLDRYEELRQEAG

SEQ ID NO: 321 - protein, 102 aa
VKDLLQAQQKLIPDLIDKMYKRFSILTTISKNQPVGRRSLSEHMDMTERVLRSETDMLKKQDVIKVKPTGMEITAEGEQLISQLKGYXDIYGDDNRLVKKGI

SEQ ID NO: 322 - protein, 60 aa
VMIMRKEIEALIFSDVSSYDIYVNTGVNQGLIGDIKDGYLTIDSMPYIDAERLYHFAYGT

SEQ ID NO: 323 - protein, 281 aa
VTCIVLVKVVENAEIKGIEIFNSVDNNNKKIFLKDGNVVGAVSCQYGDIDDGSRFYNMMKKGESTEDYTLVSLLTKGGEEASLSIADMADDETICGCNGVDKGTIVNAITENGFTTVEEVTAKTKAGNSCGKCKPQIAQILQHTLGDDFVAAKPAGICGCTDLTRDQIVTQIRAKGLKTSKEVRHVLNFKNKGGCPKCRPAINYYLNMVYPHDHEDERESRFANERYHANIQNDGTFSVIPQMRGGVTDADQLIRLGEVAKKYHVPLVKVTGSQRVGLYGG

SEQ ID NO: 324 - protein, 70 aa
VPMTPLVEPXPXTVSSNNKSNSNSSTLXYLRTLENRGWDFDGSYGWQCFDLXNVFWXSSSMGMDLKGFWR

SEQ ID NO: 325 - protein, 122 aa
VLQLITQIYGAEKRVXWVNQLVSXSFNKKIRPLRTXSDWISSNPIEVDNFIKDPYSGFNVSXQLLYHTAYYMLHTSQLKNMKMLNHAMPILLVSGYADSLGDYGKGILKLANIYREAGIKNC

SEQ ID NO: 326 - protein, 56 aa
VTLEVAEMXNSXKDXKKFEIIDRXKSFYDEEQXIDLVFVVNQINGWNRLNIISDRL

SEQ ID NO: 327 - protein, 119 aa
VDSVTIKVLNEPSPKLLTTWYAEQVTQGKIKTSKYVKKECERHLRYLENGGKWVFDEELAHRPIRFIEKFCKXSKGSKRQLALQPWQHFIIGSLFGWVHKETKLRRFKEALIFMGAKKW

SEQ ID NO: 328 - protein, 38 aa
VIXXVIKEKPXARWLFSPXSPXXAIDGDTLVTKXXASN

SEQ ID NO: 329 - protein, 211 aa
VLNLSISLTSLATGIFMVAAGDIADKIGQXRMTYMGLIIXMFXSLLLIISDITALLIIXRNFTRSISXYLGYPPTVGVLNNQFKGEHLRRAISYLMISTVGGIGLAGVIGGLIATNFGWQMNFIISIVIXFIAILLLKGTPEKVSQHXHRHPFDYKGMSIFAVMIGSFTLLLTQGFEQGWFSTFSFICLSIFIITTLIFIIIERRHEVPFY

SEQ ID NO: 330 - protein, 44 aa
VAPFLYLXINDEXXDMKIAGDLNAYNALXAYTVXRELGLNEQXN

SEQ ID NO: 331 - protein, 28 aa
VYVISLNDNAADGRDTSWIYDADFGKII

SEQ ID NO: 332 - protein, 56 aa
VMSKLRPLLHYARAKDIDNYRTVEESYRQGQYYRXXIVDGKLNIQFNEGEPYFGRH

SEQ ID NO: 333 - protein, 129 aa
VHPDVLLTRYVEGKEDQVEKVLYQLADIDISEIPKDFILLPTHPYQXNVLXQYPQYMQYSEQGLIKDLGVSGDLVSPTSXXRTVFSKALNIYLXXPIHVXITNFXRTNDLEQIXRTSCMPRMSSSSDQR

SEQ ID NO: 334 - protein, 113 aa
VQNKELIQHAAYAAIERILNEYFREENLYQVPPQNHQWSIQLSELETLTGEFRYWSAMGHHMYHPEVWLIDGKSKKITTYKEAIARILPHMAQSADNQTAVQPTYGXNYVXHR

SEQ ID NO: 335 - protein, 27 aa
VAVSFLTSRDIPXDKVVKMDVDPPXYL

SEQ ID NO: 336 - protein, 69 aa
VKNVKTQSIQNASIVTVEYENNTDMDKAEEQLKKEIDKIKFKDEVGQPELRRNSMDAFPVLAYSFQIKR

SEQ ID NO: 337 - protein, 180 aa
VMHXIFPVVSXTFASFKSMYGGIPQDFIDYLFIDEAGQAIPQAAVGALYRSKKVVAVGDPIQIEPVVTLESHLIDNIRKNYHVPEYLVSKEASVQSVADNANQYGFWKSDATDSNQKTWIGIPLWVHRRCLKPMFTIANQIAYNNKMVLASNITKVGKTGWYDVKGNAVQNIXERAWVKK

SEQ ID NO: 338 - protein, 112 aa
VKFFDYTFASVGVKPNELKQFDYKMVEVTQGAHANYYPGNSPLHLRVYYDTSNRQILRAAAVGKEGADKRIDVLSMAMMNQLTVDELTEFXVXYAPPYWHPKDLXNMIGLQS

SEQ ID NO: 339 - protein, 97 aa
VMQSSKWNAMSLLMDEKTKQAEVLRTAIDEADAIVIGIGAGMSASDGFTYVGERFTENFPDFIEKYRFFDMLQASLHPYGSWQEYWAFESRFITXNY

SEQ ID NO: 340 - protein, 93 aa
VYPIKAIIDSLTTFSGIEHRLQYVGTNRTNKYYNDSXATNTLATQFALNSFNQPIIWLLWWYWIEGDEFDELIPYMENVXHDGCIRTNESXVC

SEQ ID NO: 341 - protein, 81 aa
VMGTDKRVSPDLFIKRLNFYDYLLLNSDGLTDYVKDNEIKRLLVKEGTIEDHGDQLMQLALDNHSKDNVTFILAAIXGDKV

SEQ ID NO: 342 - protein, 30 aa
VKLKGMRKQYEVGEQASPIEFVTGRVNPHR

SEQ ID NO: 343 - protein, 82 aa
VEVQVMKFGKTIAVVLASSVLLXGCTTDKKEIKAYLKQVDKIKDDEEPIXTVXKKIAELDEKKKKLTEDVNSKDTAGSRXKQ

SEQ ID NO: 344 - protein, 162 aa
VIQSSSLLNXFKVFAAISDTVIHGSDVDLVNWVENALQSGLAAKERKDALAVSPKSGLEHMSFYNGSVKEVXGADMYDAIINALADLHEDYRDNATIYMRYADYVKIISVLSNGTTNFFDTPAEKVXGXPVGIYRCRXLPLLWEDFNYCGXYLLMGQPYDTD

SEQ ID NO: 345 - protein, 47 aa
VYKTDLYXQXXKIDTVKVIKEVELKKPITYEAGATSDSKLXKEWMDS

SEQ ID NO: 346 - protein, 62 aa
VNPRYKXTLLHRRLHTILXKMLEDLSFEAPSMPNAVVDITPQYVDDKLKSISTXKDLSAFIL

SEQ ID NO: 347 - protein, 117 aa
VKILKDTNLMYLEWNYLVXRVVAVVEXQGTLSDAVNKALQYWVSHVDDTHYLLGSALGPDPFPTIVRDFQSVIGKEXKSQILKKEGRLPDAIVACIGGGSNAIGLVPFIHLLKMMLH

SEQ ID NO: 348 - protein, 135 aa
VGRLPKKIQNIEQRPXGVSXTTFTIAVNRTFTNAQGEREADFINCVTFRKQAENVNNYLSKGSLAGVDGRLQSRSYDNKEGRRVFVTEVVADSVQFLEPKNNNQXQNNNYQQQGQAQTGNNPFDNSEEDFSDLPF

SEQ ID NO: 349 - protein, 146 aa
VVSQSILLTLSTXLTNVTXLTSXAQXPADYVKNMITGAAQMDGGILVVSAADGPMPQTREHILLSRNVGVPALVVFLNKVDMVDDEELLELVEMEVRDLLSEYDFPGDDVPVIAGSALKALEGDAQYEEKILELMEAVDTYIPLQT

SEQ ID NO: 350 - protein, 65 aa
VKVSGCSDLVQCAIHDCQYYEVQMPQAHRVVPTTINMGNHSWKALEIIYETYCTLCDSXLNKXTT

SEQ ID NO: 351 - protein, 67 aa
VXVNINCANPECNKQILVSEEXETKYLGACSYECAKHERNRYVQANNISDNEWQQRLTNFDDLHQHA

SEQ ID NO: 352 - protein, 63 aa
VTRSKMIVVESYDVNGNKVELTAHEDVARMILHIIDQMNGLPFXERADRILTDKEVEAYFIND

SEQ ID NO: 353 - protein, 40 aa
VTKNAGNHEIEIDRPIVNPIKKLPTRFTINVAIGNFEVNL

SEQ ID NO: 354 - protein, 111 aa
VKGQNLTHGTNAIDYITFDPNTNTNGITAAWANRQQPNNQQAGVQHLNVDVTYPGISAAKRVPVTVNVYQFGIPSNYLYNNSWWHFSKWYASIRICTYAKRFRFTNRWIYV

SEQ ID NO: 355 - protein, 152 aa
VTTQNQAIDNTTGATTEEKNAAKDLVLXAKEKAXQDILXAQXTNDVTQINDQAVADIQGITGDTTIXDVAIDXXATPATXXXALXGHXAXATXEXXXQXXXTKXXAQXXTXVFTXLXXCXXXXXXXVXXLAXXXRTLXSRXXXHXXXXXNRF

SEQ ID NO: 356 - protein, 65 aa
VVSLIDDEDDNXNDRQLVVSAPSKKPTTPTTYTETTTQVXMPTVERQTQQQIVYKTPKTISWIKW

SEQ ID NO: 357 - protein, 120 aa
VKIMEMSVTEVIFSFLGGLGIFLYGLKIMGDGLQASAGDRLRDILNKFTSNPVLGVIAGIVVTILIQSSSGTTVITIGLVTAGFMTLKQAIGVIMGANIGTTVTAFIIXIRFRRICKCQF

SEQ ID NO: 358 - protein, 40 aa
VLCDADVLALIDIDVDIDVLKEPDALVLVDCLVTLNHXMM

SEQ ID NO: 359 - protein, 68 aa
VLVELESLTLVEPDIESLKLVDVETDTLPLIESDVESDVLVEFDPLMLDESLVDIESLSDALMLIESN

SEQ ID NO: 360 - protein, 115 aa
VISKXQWVVVHFYPSWKDAEGHFENNGRCNLGVXTLNLPRMALESAGNMTKFWEIFYERIDVLHDALLYRINRLKDXVPNNAPILYKSGAFNYKLKETDDVAELFKNKRATISMG

SEQ ID NO: 361 - protein, 61 aa
VXSTKTALXGDAKLNEAKAAAKQTLGTLTHINNAQRNALDNEITXATNVEVLIQLKPKRNN

SEQ ID NO: 362 - protein, 241 aa
VIEMAKKAPDVGDYKYGFPADDVSIFRSERGLTENIVREISNMKNEPEWMLDFRLKSLKLFYKMPMPQWGGDLSELNFDDITYYVKPSEQAERSWDEVPEEIKRTFDKLGIPEAEQKYLAGVSAQYESEVVYHNMEKELEEKGIIFKDTDSALQENEELFKKYFASVVPAADNKFAALNSAVWSGXSLIYVPKNIKLDTPLQAYFRINSENMGQFERTLIIADEGASVHYVEGWYCTSLYN

SEQ ID NO: 363 - protein, 275 aa
VKQHKAWVNIMYGCDKFCTYCIVPXTRSKDRTRRPEDIIDEVRELAREGYKEITLLGHNVNSYGKDLQDIEYDLGDLLQAISKIAIPRVRFTTSHPWDFTDHMIDVISEGGNIVPHIHLPVQSGNNAVLKIMGRKYTRESYLDLVKRIKDRLPNVALTTDIIVGYPNESEEQFEETLTLYDEVGFEHAYTYLYSQRDGTPAAKMKDNVPLNVKKERLQRLNKKVGHYSQIAMSKYEGQTVTVLCEGSSKKDDQVLAGYTDKNKLVNFKAPKEMIG

SEQ ID NO: 364 - protein, 62 aa
VTQYLVTTFKDSTGRPHEHITVARDNQTFTVIEAESKEEAERKYEAQVKIRRDGDAKENXND

SEQ ID NO: 365 - protein, 47 aa
VYKKAQAFDEILEGMTNAIQHSVKXGIELDEAVGIMAGQVVYKYEEE

SEQ ID NO: 366 - protein, 105 aa
VIDMKFKKVLVATAMVGVLATGVVGYGNQADAKVYSQNGLVLHDDANFLEHELSYIDVLLDKNADQATKDNLRSYFADKGLHSIKDIINKAKQDGFDVSKYEHVK

SEQ ID NO: 367 - protein, 112 aa
VTNKEYEIEPGKRECEMMKRLNKLVLGISFLFLVISITAGCGIGKEAEVKKSFEKTLSMYPIKNLEDLYDKEGYRDDQFDKNDKGTWIINSEMVIQPNNEDMVAKGMVLYIE

SEQ ID NO: 368 - protein, 104 aa
VINIPKMLKYDQILVYSNPPILPLIPDVLHRLLKKKYSFVVYDIAPDNAIKTGATRPGSMIDKLMRYINRHVYKNAENVIVLGYGNEKLLTKSSNFLKMLTISM

SEQ ID NO: 369 - protein, 88 aa
VKYIEAPYEPHKFVKMVKDKELADEKEGGLRXTACFEMRLDIVAKAAVEHGYDYFGSAITLSPKKNAQLINELGMDCPKNIRCELICK

SEQ ID NO: 370 - protein, 119 aa
VTEIKYKVITKDAFALPYTIIKAKNQPTKGVIVYIHGGGLMFGKANDLSPQYIDILTEHYDLIQLSYRLLPEVSLDCIIEDVYASFDAIQSQYSNCPIFTFGRSSGAYLSLINCTRQRY

SEQ ID NO: 371 - protein, 166 aa
VIDVYNQIKNNLESMTPETATIGRLVDTKTLFLEYRKKLQDVYTDVEDVKIAISDRFKLLQSQYTDEKYKEALEIIATKFGLTVNEDLQLVGEPNVVKSAIEAARESTKEQLRDYXKTSDYXTDXDGIVERXDTAEAERTTXXGEIKDKXTVXRISKRIGRTKTIY

SEQ ID NO: 372 - protein, 303 aa
VLADITVNAMKGIYLRYDENGAITSHTIDKDGVKISGDKVDITANREFNVFANNINNKVGKNDIVNSLNLSNEGLDINVNRIGIKGGNANRYVQVQNDFIELGGIVQRTWKGKRSTDDIFTRLKDGHLRFRNNTAGGSLYMSHFGISTYIDGEGEDGGSSGTIQWWDKTYSDSGMNGITINSYGGVVALTSDYNRIIIDSYASANIESREAPIYLSPNTQKLNLXLXRFAFTLSNADRXITKLAVISCWVQDXXYKXGAGLRFSKRTNKGLVQVVNGDYATGGDTTIESGMAKFNLVXRKRWK

SEQ ID NO: 373 - protein, 95 aa
VNPTHVKYAAERLADSEVLVCTVIGFPLGASTTATKAFETEDAIQNGADEIDMVINIGALKDGRFDDVQQDIEAVVKAAKGHTVKVIIETVLLEP

SEQ ID NO: 374 - protein, 32 aa
VKIYEDTNIDTLXLLNEAXIFKXTLFWCXXSN

SEQ ID NO: 375 - protein, 55 aa
VAHDNHIGTYCIVMSGRGPSDKEVDHISNPVRTIKSQHPQLKICACLGLTDCRPS

SEQ ID NO: 376 - protein, 66 aa
VIDDLVSDHIATGQLLVKMSDLTSSYEPPIEACGTWRLVYQRLKALEVLTHEHVHLENHVLFKKVS

SEQ ID NO: 377 - protein, 54 aa
VLMIFGPEGGLSEIEISLFSNTSTVVGLGPRILRAETAPLYALSAISYEKELMG

SEQ ID NO: 378 - protein, 134 aa
VSSIWKEKEFEPSDIVDAYLVIAATNEPRVNEAVKQALPEHALFNNVGDASNANVVFPSALHRDKLTISVSTDGASPKLTKSIMAELEALYPPSYSSYIDFLYTCRQKIKVLDITYIRKATVTVTNCVTRIFKS

SEQ ID NO: 379 - protein, 244 aa
VVNHLCHGEDQDVXAHAITDLENKGIALHTNVETTELSSDDHHTTVRXNVGNXEADAVLLAIGRKPNTALALENTDIELGDRGEIKVNAQLQTSVPHIYAAGDVKGGLQFTYISLDDYRIIKSALYGNQSRTTDNRGSVPYTVFIDPPLSRVGLTSKEAAAQHYDYTEHQLLVSAIPRHKINNDPRGLFKVVINNENNMILGATLYGKQSEELINIIKLAIDQNIPYTVLRDSIYSHPTMGRII

SEQ ID NO: 380 - protein, 30 aa
VVEWALYIAKNKIAIDVPGSGMGAQCWEFT

SEQ ID NO: 381 - protein, 93 aa
VLELREEHKQHHNELRESHKELKDKQDKVVDENLEQTKILNRIEERYXTQVXVXQKNEEKTLAQNKWLVGAIWALVTIVMIAVITASIXALLP

SEQ ID NO: 382 - protein, 174 aa
VNSTLIRIGDIIQSSTNTNPIIMGIILGGIITVVGTAPLSSMALTALLGLTGVPMAIGAMAAFSSAFMNGTLFHRLKLGDRKSTIAVSIEPLSQADIVSANPIPIYITNFFGGAIAGLIIAMSGLINDATGTATPIXGFLVMXGFNHPMTIVIYGVVMAIVGCACRVILGSIRI

SEQ ID NO: 383 - protein, 76 aa
VGKTGFALNMMLNIARNGYKTSFFSLETTGTSVLKRMLSTITGIELTKIKEIRNLTPDDLTKLTNAMGSKSLKLGI

SEQ ID NO: 384 - protein, 130 aa
VPNETEAELLSGIKVTNEQSMKDNANYFLSLGIKTVLITLGKQGTYFATKNQSQHIEAYKVNAIDTTAAGDTFIGAFVSRLNKSQDNLADAIDFGNKASSLTVQKTRRASIYSSTRRSKSSLNESNTAMI

SEQ ID NO: 385 - protein, 172 aa
VYKMRKIGYARVAYPDQNLDTQLTKLLINGCDLVYSEQVNVYYKEQLELEHCLDELKTDDTLVIEKLKVLGFTPKKLMEFFESRILPYDIHLEVLDLGINTNSEEGQSFIEVFKMLADSENILLKERTTNGLESAKERGRYGGRPQLSEDKRKYIKQLFASRMYTPNEISKW

SEQ ID NO: 386 - protein, 300 aa
VLIMINEMLNPKQQEVWTCFINDKPKVLIASGAKRAGKTYVFILLFLMHIATYKDKGLNFIIGGATQASIRRNILDDMELILGRELTLDKSNAVKIFGNKVYVFDGQNSDAWKKARGFTSAGAFLNEGTALHNMFIKEVFSRCSYKGARILIDTNPENPMHPVKKDYIDKSGQRLSNGRLNIKAFQFTLFDNTFLDEEYIESIIASTPTGMFTDRDIYGKWVSAEGVVYKDFKEKVHYITEEEFKTKQIKRKYAGVDWGYEHYGSIMVVAEDFDGNKYVIEEHAHRHKEIDDWVAIAKEL

SEQ ID NO: 387 - protein, 51 aa
VNLIRSHACGLGEPFPKEVALVMMIXRLNTLLKGHSGATLVISETITIFYK

SEQ ID NO: 388 - protein, 199 aa
VIHVLDFNDKIIDFLSTDDPSLVRAIHKRNVNDNSEMLELLISSERAEXFRERHRVIIRDSNKQWREFIINWVQDTMDGYTEIECIASYLADITTAKPYAPGKFEKKTTSEALKDVLSDTGWEVSEXTEYDGLRTTSWTSYXTRYEVLKQLCTTYKMALDFYIELSSNTVKGRYVVLNKKNSLFQGKEIEYGKDLAWVN

SEQ ID NO: 389 - protein, 156 aa
VLVQGQVCSHLSTXLGLIIIDEEHESTYKQEDYPRYHAREIAQWRSEYHHCPVILGSATPCLESYARAEKDVYHLLSLPNRVNQQALPEIDIVDMREELSEGNRSMFSKDLREAIQLRXRSTGTSCFIFKSDVVMHRLCYVGIVDMYRNVQXVIFH

SEQ ID NO: 390 - protein, 88 aa
VKYLNDDIAKGSIFDYLESNMKLRIGFSDIFFNVDKLTSSEASLLQLSTGEPCLRYHQTFYTMTGKPFDSSDIVFHYXHAQFYIPSKK

SEQ ID NO: 391 - protein, 110 aa
VRHLHIPLQSGSDTVLKRMRRKYTMDRFSERLTKLHKALPDLAVTSDVIVGFPGETEAEFQETYDFIVKHKFSELHVFPYSPRIGTPAARMDDQIDEEIKNERVHKVNYA

SEQ ID NO: 392 - protein, 76 aa
VFVVEALVKTREGHGNLELLDKEVATPLDDKVKIKVHYAGICGTDLHTYEGHYXVNFPVTLGHEFSGXIVEVGSRR

SEQ ID NO: 393 - protein, 98 aa
VTSHVNSIKIHIGRXKQGKTILKNISCHIPKGDKWILYGLXGAGKTTLLNILNAYEPATTGGVNLFGKMPGKVGYSAETXRQHIGFVSHSLLEKXPRG

SEQ ID NO: 394 - protein, 68 aa
VVISGAFKSTGVYQDIDDEVRNEAHHLLKLVGISAKAQQYIGYLSTGEKQRVMIARALMGQPQVFNFR

SEQ ID NO: 395 - protein, 273 aa
VTXGVXPKPLHANLMIRTLSGHIQHIAFGPIASLESIKHLGTNGGGFLAGNSATPFENPNIWSNFIEMGSMMLLPMSMLFLFGRMLSRHGKRVHRHALILFVAMFFIFIAILTLTMWSEYRGNPILANLGIYGPNMEGKEVRFGAGLSALFTVITTAFTTGSVNNMHDSLTPIGGLGPMVLMMLNVVFGGEGVGLMNLLIXXLLTVFICSLMVGKTPEYLNMPIGAREMKCIVLVFLIHPILILVFSALAFMIPGASESITNPSFHGISQVML

SEQ ID NO: 396 - protein, 102 aa
VCEFIKPPTHVXGIILGVVGGYVXARNXXLQKQSQARQTAXDIVXQAHKEADXIKKEKLLXAKEEXQLXREXTEAEXRERRXDLXRQGNPTSSKRRKLRAHS

SEQ ID NO: 397 - protein, 122 aa
VRLHLCLHQRKAFLTDWSYIAGNIAIVAIIPLLIYFYVPFFKKLKVTSAYEYLEARFGPSIRVXGSLLFVVYHLGRVAIVIYLPTLAITSVSDMNPYIXGSLVGLLCIXXTSXGXFXGVRLE

SEQ ID NO: 398 - protein, 121 aa
VYKITINEVFNMTETTFNPITSLTINNEEVKAKATFMFDKTAKKFATEQEDNKGRKQTISGFTNVYXALLERDTVAIVDFWECATAYLGKSAPKREDIEAEIMEIIERENDTLIFYKVRWT

SEQ ID NO: 399 - protein, 39 aa
VPSNKVAFIPSEAQFIQLCQDDNDVKQASHNLYDGVTFT

SEQ ID NO: 400 - protein, 108 aa
VNGVQDNSIGSTNESQFLGNYIVIKHAENEYSLIAHLQQYSIIVNEGQNVKYGDFLGKVGNSGNSTEPHIHFQVMNDKNIEACTSLKIRFLNNLELIKGDVVCGLQGE

SEQ ID NO: 401 - protein, 96 aa
VHKENIMLNXSATDKESVLXQMSDVLFQNGFVKSTFKDAVIDREKEXXTGLPTHLCSVAIPHTDVEHINHRTIGVGVLEKEVAVIGMGTIGSTGRR

SEQ ID NO: 402 - protein, 52 aa
VRAAFGKNGGNMGVSGSVAYMFDHVATFGIEGKSVDEILETLMEPRCKMXMM

SEQ ID NO: 403 - protein, 79 aa
VMFNTTVNSDTDVIKYGRLLVDKGAQSVIVSLGGDGAIYIDKEISIKAVNPQGKVVNTVGSGDSTVAGMVAGIASRFND

SEQ ID NO: 404 - protein, 123 aa
VPISNDAIVELVSRIKPVSEMMERETDLGVATEFEIITAMMFLYFGEIHPVDFVIVEAGLGIKNDSTNVFTPVLSILTSIGLDHTDILGGTYLDIARDKGAIIKPNVPVIYAVKNEDALKYVR

SEQ ID NO: 405 - protein, 83 aa
VFIGTYMILSIRKESDAVITDTDEALKQVLKMVXENKVISQNNKEVTLQADTICVHGDGEHALLFVSQIREILMXEGIDIQSL

SEQ ID NO: 406 - protein, 87 aa
VFADRRYEDDGQLVSRKESDAVITDTDEALKQVLKMVXENKVISKNNKEVTLQADTICVHGDGEHALLFVSQIREILMKEGIDIQSL

SEQ ID NO: 407 - protein, 90 aa
VYDIEVSDYKGLTYKLEAFRGKVILVVNTATECIYSEQLKKLETLXQKYKDRGFVVLSSPNNNCDNRQPXSNEEILKIXRXEIWVLHFQC

SEQ ID NO: 408 - protein, 61 aa
VEIENEPYFVGKDIAEILGYARADNAIRNHVDSEDKLTHQFSDSRSKQKCNDQSTNQDYTV

SEQ ID NO: 409 - protein, 139 aa
VRXLIXESXIDLASPXDNRPFIDVFLEPTKLYVXPVLALKKEVSIKAMNHITGGGFYENIPRALPAGYAARIDTTSFPTPKIFDWLQQQGNIDTNEMYNIFNMGIGYTVIVDEKDASTRFEDFSRTKCGSLSNWSYCEK

SEQ ID NO: 410 - protein, 83 aa
VPIFPNKALIESAVARGELDESVFNQLVTDMLLEHHYNIPQHYINLYIDNIKTLKDVPASYMNHSNVDVVADLLLEKSKRXYG

SEQ ID NO: 411 - protein, 45 aa
VLFIGFFVVIINTIADLLTLLLDPKQRLQLGNPTKHNQYTIDIRK

SEQ ID NO: 412 - protein, 101 aa
VLIEVHDPHELERAXXVNAKLIGVNNRDLKRFVTNVEHXNTILENKKPNHHYISESGIHDASDVRKILHSGIDGLLIGEALMRCDNLSEFLRQLKXXKVKS

SEQ ID NO: 413 - protein, 88 aa
VSDEPXIYKFIQHNXENFIXTASXIMDGHTXVAPLKXTHKLPCAFCSYQSVCHVDXMIDSKRYXXVDETINPIEAIHNININDVFGGE

SEQ ID NO: 414 - protein, 55 aa
VDHLXVTLRIDRENHMYGRLASESVVENMFTPVHDDNLKNEVIEAKPWXERITNW

SEQ ID NO: 415 - protein, 75 aa
VXYMDKGLTGHIMRRGITEADASINWALGLMNEGSQIIDNTTNLCGDRTTXXLKSGGXGTGEQKINLTSKXAQIW

SEQ ID NO: 416 - protein, 73 aa
VYKQGEPNLWTGRLDSETDPKKFRHFQTVTFEDLSKLEKSSMPSGVGILGYAVGQRCCFXQGAHWCKRRTRCD

SEQ ID NO: 417 - protein, 130 aa
VHHITHYIDQLDRFSSPGDVIKXHSGGYHHKYGTFNKLGYINENYIELLDVENNEKLKKMAXTIEGGVACATQIAQEKYEQGFKNMCVXTNDIEAVKNNLQXEQVXVVAPTQMERDTHKDGKVKWQLLIL

SEQ ID NO: 418 - protein, 92 aa
VRGSKIQTIGVILPSLTNPFFSALMQSIHDHKPSDVDLCFLTSTATDXYDNIKHLIDRGIDGLIIAQYISSPDALNNYLKKHHVPYVVLDQK

SEQ ID NO: 419 - protein, 98 aa
VLXDEXXVDKDALRNNALVKGQFKADHQYQIVIGPGXVDEVYKQFIDETGAQEASKDEAKQAAAKKGNPVQRLIKLLGEIFIPILPAIVTTGLLMGIQ

SEQ ID NO: 420 - protein, 163 aa
VIQLLMHMIHYGTSVHIIRTQSILNDDKVNQVCDYIELHFHEDLSLSELSEYVGWSESHLSKKFTESLGVGFQHFLNTTRIEHAKLDLTYTDETITDIALQNGFSSAASFARTFKHFTHQTPKQYRGDRPAITENQQSAQHNYHDRELILLLNDYIEEMNQFN

SEQ ID NO: 421 - protein, 105 aa
VNLGGSVTSIQPLRINLTSNENFTDKDWQITGIPRTLHIENSTNRTNNARERNIELVGNLLPGDYFGTIRFGRKEQLFEIRVXPHXPQLQRQLSNXEVRNYKSAC

SEQ ID NO: 422 - protein, 56 aa
VIKRLINETFDANYIEVIEGGIEETQTLIHLPFDYVSYRSEIVGKSFIKLQRNLVL

SEQ ID NO: 423 - protein, 85 aa
VITFVLVPVLIPTLKRMKFGQSIREEGPQSHMKKTGTPTMGGLTISIKVFVITVFGGYYICKIKLIQSYLLLFVTDWFWVNWFYR

SEQ ID NO: 424 - protein, 49 aa
VMXNGXLIEHGTRESVLHHPEHVYTKYLLSXXKKXNDHFKHVMRGDVHX

SEQ ID NO: 425 - protein, 80 aa
VPTIDSVKTYGLVSIPGMMTGLIIGGVPPLQAIKFQLLVVFIHTTAXIMSALIATYLSYGQFFNARHQLVARNTDVKSES

SEQ ID NO: 426 - protein, 100 aa
VMPXVFWXPFPXIFIGTALPLAGTVATGAIHFTANEVIPIGXMLXNNGLIAINLAYQNLDRAFVQDGTNIESKLSLAATPKLASKGAIRESIRLAIGANN

SEQ ID NO: 427 - protein, 40 aa
VKVGKSMEGLNHRRNTEKEETTQTQSVAPNTGEEGMSSGK

SEQ ID NO: 428 - protein, 62 aa
VQFLNQWLGDTLAFKVKHMLRQRVIYKNNGHPIGEQMTILTENIDGLAPFYKSYLPQVVQID

SEQ ID NO: 429 - protein, 116 aa
VVIXIALISXVFLPGIFYVISCVVGYLCFGLGLGIYATPSTDTAISNAPLDKVGVASGIYKMASSLGGAFGVAISGAVYVGAVAATSIHTGAMIALWVNVLMGIMAFIAILFGAXS

SEQ ID NO: 430 - protein, 107 aa
VELGYLFRNYRLFNMDGLALKLNLSSCLFSRKSMIYFNIGQIIANIICWALIAPTLDILIYNEPANKVYTQGVISAVLNIISVGIIGTILLKAYASSQIKKGSLRKE

SEQ ID NO: 431 - protein, 137 aa
VYAGENFMILLASRLDAVVYSLGLARTRRQARQLVNHGHILVDGKRVDIPSYSVKPGQTISVREKSQKLNIIVESVEINNFVPEYLNFDADSLTGTFVRLPERSELPAEINEQLIVEYSCQDNTFITITHNCGCFFY

SEQ ID NO: 432 - protein, 104 aa
VHLVRMVYKGKISDHYLSVWEKATTYQMYHGLALLIIGVISGTTSINVNWAGWLIFAGIIFFSGSLYILVLTQIKVLGAITPIGGVLFIIGWIMLIIATFKFAG

SEQ ID NO: 433 - protein, 65 aa
VLKLFQMRSPIFREPSANNAVKTLIAMGSILAFLLVGIGGLAYVYGIMPQTETTVLSQLAMQIFG

SEQ ID NO: 434 - protein, 68 aa
VMRGTIIIPTTKPGLIALNSPRPDMKDLNTGVTKVNAKKPNTIVGIPAKISNIGLIMRRARALAYSLK

SEQ ID NO: 435 - protein, 47 aa
VSDTAVMIAWLVKIPHSTMPILGTSQLKRXDQAIEGLQLNLDDQVVG

SEQ ID NO: 436 - protein, 53 aa
VDIPLLFENELENTVDEVWVVYTSESIQMDRLMXRXDLSLEDAKARVYXPNFY

SEQ ID NO: 437 - protein, 111 aa
VMQVFTWQQYVEIVVNEGRDAANAAQEKAVKEGKIIIKDSIADIFLQQILTRPAEHDVVATMNLNGDYISDALAAQVGXIGIAPGANINYETGHAIFEATHGLXSKICRFK

SEQ ID NO: 438 - protein, 33 aa
VSMFITGMQYGDKVAVHVSRGAVFGMTGVLVVF

SEQ ID NO: 439 - protein, 105 aa
VVTDQLLAFFNNRYWRSQFNPRGGWSPSGPRRYANGGLITKHQLXEVGEGDKQEMVIPLTRRKRAIQLTEQVMRIIGMDGXPNNITVNNDTSTVEKLFETNCYVK

SEQ ID NO: 440 - protein, 109 aa
VAGALDVNQVNVSENDNANQPHSVLLIDTQAVDENNSELNQVGTSTKAQIAFCIDVRSEPFRRHIEAAGPFETIGIAGFFGLPIQKDAVDEQFKHDSLPVMSRAAGISH

SEQ ID NO: 441 - protein, 28 aa
VTFGVTGTNGKTSIATDDSFNSXKVTKK

SEQ ID NO: 442 - protein, 110 aa
VDGTANGVGSTLXLNESLDQFILLIFYGTFPGGDFTEFGSPFGGGKISLNPSNLPDGDGNGGGVYEFGLTKSSRTSLTISNDVYFDLGSQRGSGANANRGTINKIIGVRK

SEQ ID NO: 443 - protein, 108 aa
VLDNDLNQVTLADYAGKKKLISVVPSIDTGVCDQQTRKFNSEASKEEGIVLTISADLPFAQKRWCASAGLDNVITLSDHRDLSFGENYGVVMERTSCRIRHELVQYLY

SEQ ID NO: 444 - protein, 133 aa
VSQERYSRQILFKQIGEIGQSKINQKCALIIGMGALGTHVAEGLVRAGIAKLIIVDRDYIEFSNLQRQTLFTEEDALKMMPKVVAAKKHLLALRSDVDIDGCIAHVDYYFLGNTWTGRWTLLLMQPITLKHDN

SEQ ID NO: 445 - protein, 144 aa
VTLMKLVFVARAGNMAQAIFTGIINSSNLDANDIYLTNKSNEQALKAFAEKLGVNYSYDDATLLKDADYVFLGTKPHDFDALATRIKPHITKDXCFMSIMAGIPTDYIXQQLECQNPXARIMPXTXAXVGHSVTGISFSNNFEP

SEQ ID NO: 446 - protein, 46 aa
VHRSLMKILINVLEQFDNAVVLFMGAGDIQKLQNAYLDKLGMKNAF

SEQ ID NO: 447 - protein, 64 aa
VFENEPLKPNHELYELENVTITAHITGNDYEAKYDLLDIFKNNLVNFLNKNGLIENEVDAKKGY

SEQ ID NO: 448 - protein, 86 aa
VKEITKLNGLCLKWVAPGTRGVPDRIIIMPEGKTYFVEMKQEKGKLHPLQKYVHRQFENRDHKVYVLWNKEQVNTFIRMVGGTFGD

SEQ ID NO: 449 - protein, 115 aa
VWGIVILGGYEQFIKSHLRKIYIDGVSNMQEHVVVTLDGKDYLVEPGTNLLEFIKSQDTFVPSICYNESMGPIQTCDTCTVEIDGKIERSCSTVIDRPMTVNTVNNDVKDAQKEP

SEQ ID NO: 450 - protein, 50 aa
VLTMISYLLFLLSGLANGLINMNKEGIDKWQADAIXLNKDANQTVQXSCF

SEQ ID NO: 451 - protein, 174 aa
VKKVVKYLISLILAIIIVLFVQTFVIVGHVIPNNDMSPTLNKGDRVIVNKIKVTFNQLNNGDIITYRRGNEIYTSRIIAKPGQSMAFRQGQLYRDDRPVDASYAKNRKIKDFSLRNFKELDGDIIPPNNFVVLNDHDNNQHDSRQFGLIDKKDIIGNISLRYYPFSKWTIQFKS

SEQ ID NO: 452 - protein, 146 aa
VSKLKKELLEWIISIAVAFVILFIVGKFIVTPYTIKGESMDPTLKDGERVAVNIIGYKTGGLEKGNVVVFHANKNDDYVKRVIGVPGDKVEYKNDTLYVNGKKQDEPYLNYNLKHKQGDYITGTFQVKDLPECESQIKCQSKRVNI

SEQ ID NO: 453 - protein, 107 aa
VERNQKVPXGPENPEKPSRPTHPXGPVNPNNPGLSXDRAKPNGPGPFNWIKMIKVKKSKIAKESVANQEKKRAELPKTGLESTQKGLIFSSIIGIAGLMLLARRRKN

SEQ ID NO: 454 - protein, 54 aa
VTHVDVDERLIDFQIVGMPLPKNDRSQRPARGKTIQAKTRGKSLDKSKSDDKGR

SEQ ID NO: 455 - protein, 62 aa
VFHILQNIGMTIQLLPITGIPLPFISYGGSALWSMMTGIGIVLSIYYHEPKRYVDLYHPKSN

SEQ ID NO: 456 - protein, 74 aa
VTXREVVNHIEQTIXQYGVNEMSFDTMVLFGDHXASPHGTPGDRRLKSNEYVLFDLGVIYEHYCSDMTRTIKFW

SEQ ID NO: 457 - protein, 28 aa
VQVGDGPXQREIVFPNSTDXXSWGGXTK

SEQ ID NO: 458 - protein, 70 aa
VGPNTEAEFRKEIQLPGNASWGVGPNTEXIGFPISSDNASWGVGPNKENFEKKFYRQCELGCGPQHRSLR

SEQ ID NO: 459 - protein, 32 aa
VTRLFYMFDKETMIASMGIGGGLGNAALFTRF

SEQ ID NO: 460 - protein, 53 aa
VSAIVXYXSFDCXIRKFKLKTPGREDEETEIRNSSVAKLPXDVLDXMGWKRKH

SEQ ID NO: 461 - protein, 136 aa
VLRMTEQPSYYSIITANVRYDNRLTDSEKLLFAEITSLSNKYGYCTASNGYFAKLYEVTKVTVSRRIANLKECGYLHVEIIRNGNEIKQRKLYPLTEMIRPINTNDNTPINNSVNTPIITNVKETIQVLIIQVITI

SEQ ID NO: 462 - protein, 290 aa
VGFXAAIRMDKSGYSXSLYEQNTHIGGKVNXHESDGFGFDLGPSILTMPYICEKLFEYSKKQMSDYVTIKRLXHQWRSFFPDGTTIDLYEGIKETGQHNAILSKQDIEELQNYLNYTRRIDRITEKGYFNYGLDTLSQIIKFHGPLNALINYDYVHTMQQAIDKRISNPYLRQMLGYFIKYVGSSSYDAXAVLSMLFHMQQEQGXXYVEGGIHHXANALEKLAREEGVTIHTGARVDNIKTYQRRVTGVRLDTGEFVKADYIISNMEVIPTYKYLIHLGYSTIKQIREGI

SEQ ID NO: 463 - protein, 224 aa
VRTSRQSPFAQRIEQQQKRLNLPDLPTTTIGSFPQSREVRKYRADWKNKRITDEAYETFLKNEIARWIKIQEDIGLDVLVHGEFERNDMVEFFGEKLQGFLVTKFGWVQSYGSRAVKPPIIYGDVKWTAPLTVDETVYAQSLTDKPVKGMLTGPVTILNWSFERVDLPRKVAQDQIALAINEEVLALEAAGIKVIQVDEPALREGLPLRSEYHEQYLKDAGFII

SEQ ID NO: 464 - protein, 118 aa
VKMMPRKFRVLQIGGDDLEPIFQHKKGVSWDYFDIGLFEFDSGYVEAIEAIVEAEGRFDFIYIQAPYSETLTNLLQMISEPYNTYVDESFWSVEYEQDENCPKIRCSTNYITGILEGT

SEQ ID NO: 465 - protein, 194 aa
VRKGYYPIKRAIDLVLSIVLLFLTFPIMFIFAIAIVIDSPGNPIYSQVRVGKMGKLIKIYKLRSMCKNAEKNGAQWADKDDDRITNVGKFIRKTRIDELPHLINVVKGEMSFIGPRPERPEFVELFSSEVIGFEQRCLVTPGLTGLAQIQGGYDLTPQHKLKYDMKYIHKGSLMMELYISIRTLMVVITGEGSR

SEQ ID NO: 466 - protein, 93 aa
VKALKLYGVEDLRYEDNEKPVIESANDVIVKVRATGICGSDTSRNXXMGPYIKGMPFGHEFSGVVDAIGSDVTHVNVGDKVTGCPAIPCYQCE

SEQ ID NO: 467 - protein, 105 aa
VGEAESSLSFIGELDNIDDKTYQDALVIVCDTANAPRIDDERYSTGSKLIKIDHHPAVDQYGDINLVNTNASSTSEIIYDLISHFNDEAIVNKGTSECFIPWYRR

SEQ ID NO: 468 - protein, 250 aa
VMSLVIVLIKDGCVSKFSLIRQGNMIKRDXPMIPLHQTEEEEFYTFIGQFYSLNQHILPKEVHVPRNLDKEMIQSVVDTKIVQPARGPKKDMVDLAAHNAKVSLNNKFELISRDESRTIKAIEELGTQMGIQTPIRIEAFDNSNIQGVDPVSAMVTFVDGKPDKKNYRKYKIKTVKGPDDYKSMREVVRRRYSRVLNEGLPLPDLIIVDGGKGHMNGVIDVLQNELGLDIPVAGLQKNDKHQTSELLLWR

SEQ ID NO: 469 - protein, 68 aa
VVQXTRFHNICPHKQGPLSEGTVSGEYVFCPLHDQKIDLNTGIVQEPDEGCVDVYEVEVTDGNVYICL

SEQ ID NO: 470 - protein, 95 aa
VHVLAFLTKHHSEKFNSSSLAELTCLXPVQLRRVTTQLVDLXMIDTIRGKDGGYLANDQSADVSLATLYKHFVLEKEQHTRLFTWRRRQSLSNCS

SEQ ID NO: 471 - protein, 162 aa
VGFLNHMLTLFTFHSGLSLNIEAQGDIDVDDHHVTEDIGIVIGQLLLEMIKDKKHFVRYGTMYIPMDETLARVVVDISGRPYLSFNASLSKEKVGTFDTELVEEFFRAVVINARLTTHIDLIRGGNTHHEIEAIFKAFSRALGIALTATDDQRVPSSKGVIE

SEQ ID NO: 472 - protein, 67 aa
VNTAMGNLKQGIANKDTVKASENYHDADVDKQTAYTNAVSQAEGIINQTTNPTLNPDDITPCINSSD

SEQ ID NO: 473 - protein, 99 aa
VEAQKDVANVLENVEQVDAXVGATDTIALAAYKYYSDKNDVMKPHQIYGXGGDPMTQLVSPSIKTIHYNYCEAGQCARWQRYNRCLKSKICHIASQXDC

SEQ ID NO: 474 - protein, 89 aa
VDHEVFQQFGESLPVYKPTLPPMVFGNRDKKIXGGTDALVLRYLTPHGXWNIHSMYQDNKHMLTLFRGVHRFGYXMKMLXNTISKIMIG

SEQ ID NO: 475 - protein, 99 aa
VYXRNGVVTARAVISHRMPKGTMFMYHAQDKHIQTPGSEITDTRGGSHNAPTRIHLKPTQLVGGYAQISYHFNYYGPIGNQRDLYVAVRKMKEVNWLED

SEQ ID NO: 476 - protein, 173 aa
VTWGTNPEMGVNFSEPFPEINDINDQRAYDYMGLEPGQKAEDIDLGYVFLGSCTNARLSDLIEASHIVKGNKVHPNITAIVVPGSRTVKKEAEKLGLDTIFKNAGFEWREPGCSMCLGMNPDQVPEGVHCASTSNRNFEGRQGKGARTHLVSPAMAAAAAIHGKFVDVRKVVV

SEQ ID NO: 477 - protein, 264 aa
VWNRHVLXGKXGDPQLLYIDLHLIHEVTSPQAFEGLRLQNRKLRRPDLTFATLDHNVPTIDIFNIKDEIANKQITTLQKNAIDFGVHIFDMGSDEQGIVHMVGPETGLTQPGKTIVCGDSHTATHGAFGAIAFGIGTSEVEHVFATQTLWQTKPKNLKIDINGTLPTGVYAKDIILHLIKTYGVDFGTGYALEFTGETIKNLSMDGRMTICNMAIEGGAKYGIIQPDDITFEYVKGRPFADNFAKSVDKWRELYSDGTTRYLIV

SEQ ID NO: 478 - protein, 81 aa
VIINKVMTSDTPVTIVATGPLTNVATALIRDPRIAEHIESITLMGGGTFGNWTAYSRILSIPTSFLTKSXCGFVNMPLGVI

SEQ ID NO: 479 - protein, 54 aa
VAHXHVVNGTYYLHXHIVXGWQGVKKTCDTAEELDTYIKXSDVVYEEQKHLXLF

SEQ ID NO: 480 - protein, 45 aa
VAHIHVVNGTYYFHGHIVPGWQGVKKTFDTAEELETYIKQSDSGI

SEQ ID NO: 481 - protein, 148 aa
VCTYCGVGCSFEVWTKDREILKVQPSHDSPANKIATCVKGKFSWGHINSDQRLTKPLVRKNGEFHEVEWDEALNVIADNFTSIKEKYGPDALSFISSSKATNEESXLXQKLARQVIGTNNVDSLXKDIXKHLQQKAYLERLDTAGDSR

SEQ ID NO: 482 - protein, 106 aa
VTKAVGERIPITIIVAVLALIVALIIAIPIGIISAMKRNSWLDITLMIIALIGLSIPSFWQGLLFILAXSLKLDILPPSYMPEHPISVDFTCTCHWNKYCCFYHAY

SEQ ID NO: 483 - protein, 46 aa
VAELLGGSAVTEQVFNINGIGRYIVQKQLIPDIPAVMGGVVYIYQL

SEQ ID NO: 484 - protein, 152 aa
VTHIIIDGDACPVXDSIIDLTTETGIFVTIIRSFSHFSNQLYPPHVSTLYVDDGPDAVDYKIVQLSTKDDIVVTQDYGLASLLVDKVLIVMHHNGKIYNSKNIQQLLDKRYMNAQIRKQGGRHKGPPPFTKQDQKVFEQSLLKVIHRIKELD

SEQ ID NO: 485 - protein, 66 aa
VIESLPEHVDTIIDIKSRTEGELITKEKELVQLKFTPENIDNVDKEYHRETFGEFDTRRTFEKCNS

SEQ ID NO: 486 - protein, 117 aa
VDSIILDAAQTPLVISGAPRLQSNLFHIVKEFVDTLIEDVHFKMKKTKKEIWLLNQGIEAAQSYFNVXDLYSEQAMVLVRNINLALRSCRMFLGSYKSYRCKNVLKFGCMIGEQPGG

SEQ ID NO: 487 - protein, 270 aa
VVSLAXVLIIGIGALTNSISXNLGRNTVLVLGIALPXIYFTLIIRSXDVXDTXRSRVKAFIPLFILGMVFWAIQEQGSNVLNIYGXXHSDMKLNLFGWKTXFGEAIFQSINPLFILLLAPIISLLWQKXGTKQPSLPVKFAIGTFLAGASYILIGIVGYASGSSNFSVNWVILSYIICVIGELCLSPTGNSAAVKLAPKAFNAQMMSIWYLTNASAQAINGTLVKLIEPLGQTNYFIFLGVVAIIVTTICISILTFNHQSDERYTLILLA

SEQ ID NO: 488 - protein, 80 aa
VTPPHPNGVSQEVLAACYLTQXTQVXXXGGAXSIAXLTYXAXTIPKVDKIXGPGTQFVASXXKXLFGQVAYCSHXRXTXQ

SEQ ID NO: 489 - protein, 45 aa
VFQVGGAQSIAALTYGTETIPKVDKIVGPGNQFGXICPKNIYLDR

SEQ ID NO: 490 - protein, 96 aa
VGMSIVLAGGMENMSQXPMLXNNSRFGFKMGHHSMVDSMVYDGLTDVFTQYHMGITAENLVGAIWYFKRRTKIHVAGNLTTIKQYVHSKMVNLIVK

SEQ ID NO: 491 - protein, 130 aa
VISMKWLSRILTVIVTMSMACGALIFNRRHQLKTKTLNFNHKALTIIIPARNEEKRIGHLLHSIIQQQVPVDVIVMNDGSTDETARVARSYGATVVDVVDDTDGKWYGEITCLLSRCDACMYESYCLCRC

SEQ ID NO: 492 - protein, 124 aa
VPILGTVFTALTGPIGIVLGVLAGLAVAFTIAYKKSETFRNCVNGAINSVKQTFSNFIQFIQPYIDSVKNVFKQAVSAIGDFAKDIWSQINGFFNENGISIAQALQNICNFIKAIFEFILKFCN

SEQ ID NO: 493 - protein, 147 aa
VKSLKTVIGMNNKEHIKSVILALLVLMSVVLTYMVWNFSPDIANVDNTDSKKSETKPLTTPMTAKMDTTITPFQIIHSKNDHPEGTIATVSNVNKLTKPLKNKEVXSVEHVRRDHNLMIPDLSSDFTLFDFTFDLPLSTYLGQVXEH

SEQ ID NO: 494 - protein, 90 aa
VILPKLVTYQVQPMSMMLIPKGXXELALRFNQGINXGGDALKKRTHFNIAGAFNPDVRKLDGAVXRLEXKDXKRNVLFXNTTRVQQRENH

SEQ ID NO: 495 - protein, 126 aa
VLVQPHIVIKPEAQQAIKATAENQVESIKDTPHATVDELDEANQLISDTLKQAQQEIENTNQDAAVTDVRNQTIKAIEQIKPKVRRKRAALDSIEENXKNQLGCNPEIRGILLKDERDCWLLDTFK

SEQ ID NO: 496 - protein, 46 aa
VSLLPLISDNMYLGYIAGLLAAYAGGFVCTYLFGPTKAMRQDRFVG

SEQ ID NO: 497 - protein, 90 aa
VGXXIMKFKAIAKXSLALGMLATGVITSNVQSVQAXTEVXQQSESELXHYYNKPVLERKNVTGYXYTEKGKDYIDVIVDNQYSQISLVRI

SEQ ID NO: 498 - protein, 147 aa
VINIELVLHQRXANPVRIANISNNATVSQADQATIINSLTFTSNAPNRNYATASANEITSKTVSNVSRTGNNANVTVTVTHQDGTTSTVTVPVKHVIPEIVAHSHYTVQGQDFPAGNGSSAADYFKLSNGSAIPDATITWVSGQXPK

SEQ ID NO: 499 - protein, 274 aa
VMENSRPERNEATMHLDEMTVEEALITMNKEDQQVPLAVRKAIPQLTKVIKKTIAQYKKGGRLIYIGAGTSGRLGVLDAAECVPTFNTDPHEIIGIIAGGQHAMTMAVEGAEDHKKLAEEDLKNIDLTSKDVVIGIAASGKTPYVIGGLTFANTIGATTVSISCNEHAVISEIAQYPVEVKVGPEVLTGSXRLKSGTAQKLILNMISTITMVGVGKVYDNLMIDVKATNQKLIDRSVRIIQEICAITYDEAMALYQVSEHDVESCDSYGYVWHF

SEQ ID NO: 500 - protein, 228 aa
VXXIHSQQIVIAPDSFKESMXXHQVXNIIKQAFTNVYGNTLHYDIIPMPDGGEGTXDXLIHAXXATKYTVIVNDPLMRPIEACYARADEQQIAIIEMAAASGLDLLEKEERNPLYTSSYGTGELIKDALNHGAKTIILGIGGSATNDGGTGMLSALGVKFTDVNGDLLQMNGANLAHIAQIDITNLADSRXKEVTFKVACDVSNPLLGENGATYIYGPQKCADAKMHT

SEQ ID NO: 501 - protein, 117 aa
VKQCINNDEWFVTNDNGYVKEQYLYXAGRQQDMLIIGGRNIYPAHVXRLLTQSSSIDEAIIIGIPHERFGXIGVLLYSGDVTLTHKNXKQFXKKKVKRHEIPFDDSSCRKDVLXCKW

SEQ ID NO: 502 - protein, 138 aa
VSAIFEPEHLEALLAQVSIKPVINQVEYHPYLTQHKLKLYLAAQHIVMESWSPLMNAQILNDETIKDIAQELGKSPAQVVLRWNVQHGVVIIPKSVTPNRISENFQIFDFELSDEQMTLVPGLNLDKRIGPDXXTFEG

SEQ ID NO: 503 - protein, 78 aa
VFKGSEYQLSEINSGSVKYEQTYDNFPILNNSKAMLNFNIEDNKAASYKQSMMDDIKPTDGADKKHQVIGVRKAIEAL

SEQ ID NO: 504 - protein, 42 aa
VNETNVQLLQPNWEIKVKHDGKDKTNTYYVEATNNNPKIINH

SEQ ID NO: 505 - protein, 36 aa
VLIYFIEGLMSXNQPAEALEXLSYVDPSPXXLMXKK

SEQ ID NO: 506 - protein, 75 aa
VGINSKQGKNLIGAFYRPTAVIYDLDFLKTLPFEQILSGYAEVYKHALLNGESTTQEIEQHFKDREILQPLNGIG

SEQ ID NO: 507 - protein, 153 aa
VVTLFLCPXNSFLMIHNSWVMTVGNAEELRKTADLLEKTDAVSNSAYLDKXXDLDQEHLKQMLDAETWLTAEEALSFGLIDEILGANEIAASISKEQCRRXEXVPEDLKKDVXKITKIDDXRYDLDWLKPPKESMSLEEXXXRXXIVRSNAKF

SEQ ID NO: 508 - protein, 115 aa
VKEIPDASISFEVFADDLETMEKEAAILKQYGENVFVKIPIVNTKGESTIPLIKKLSADNVRLNVXAVYTIEQGKEITEAVTEGVPNICFSICRTYCRYRRRSITINERGCKSYA

SEQ ID NO: 509 - protein, 197 aa
VYXRVNEMNAKEXLVDXLMKTSSQLFKXHGEVXMQLXLNDELKLPSIXEICVERKRLSDIVKVIPQSYALLYIDKQDQARAKXXLSLXKIAKVYVQYDDTTIMSIFVYDVVNDEWILRLDPNIRIPKSNIYFHSLNWDVDYIKPEIVLMYDLMQHHQYHHYSNYKRVIDXLSYYQFFILKFVVGEXRIKDAIQKNNK

SEQ ID NO: 510 - protein, 56 aa
VPPQQQAPTKQRPAKXENDDKASXDESKDKDDNASQDXSDDTQKKTDDNTHPAARX

SEQ ID NO: 511 - protein, 77 aa
VLMLKMXLIKKLTQMEDLVNQNDXLTDEEKQXAIQVIEEHKNEIIGNIGDQTTDDGVTRITRSRYTDLKWGYCNTGC

SEQ ID NO: 512 - protein, 166 aa
VKWIKRLLKDLKKLSMLFKDILQLVPKQLFGGGDAELQLTEADYLTAGIDIVVQPPGKKLQHLSLLSGGERALTAIALLFAILKVRSAPFVILDEVEAALDEANVIRYAKYLNELSDETQFIVITHRKGTMEFADRLYGVTMQESGVTKLVSVNLNTIDDVLKEEQ

SEQ ID NO: 513 - protein, 88 aa
VRDQFKFYHVRHEEVASLAAAGYTKLTGXIGVALSIGXPGLIHLLNGMYDAKMDNVLVPINIIWTNXIVQHLERKHFKKQIYKNYVKM

SEQ ID NO: 514 - protein, 153 aa
VKLSXYYPQGLRSLNGGRMARFGRTPLLDAMEMANEHIMVIAMIEDVXGVMAIDDIAQVEGLDMIVEGAAGFIAVTWHTXANERDDQVTSHXQHIXXVVNAHGKHXCALPREDEDIAKWQAQGVQTFILGTSGKIYRHLSASLATSKQKGDDG

SEQ ID NO: 515 - protein, 105 aa
VLTSLDADEAKRNAYTNAVTQAXQILNKAQGPNTAKDGVETALQNVQRAKNELSGNQNVANAKTTAKNALNNLTSINNAHKAALKSQIEGATTVAGVNQVSTMAS

SEQ ID NO: 516 - protein, 276 aa
VNTAKTALNGDARLNEAKNTAKQQLATMSHLTNAQKANLTEQIERGTTVAGVQGIQANAGTLNQAMNQLRQSIASKDATKSSEDYQDANADLQNAYNDAVTNAGGIISAXNNPEMNPDTIXQKASQVNSAKSALXGDEKLAAAKQTAKSDIGRVTDLNNAQRTAXNAEVDQAPXLAAVTAAKNKATSLNTAMGNVKHALAEKDNTXRSVNYTDADQPXQQAXDTAGTQAEAITNANGSXANETQVQAALNQLNQAKNDLEWVIIKLLKRKKQQNVH

SEQ ID NO: 517 - protein, 234 aa
VNTTKAALHGDVKLQNDKDHAKQTVSQLAHLNNAQKHMEDTLIDSETTRTAVKQDLTEVQALDQLMDALQQSIADKDATRASSAYVNAEPNKKQAYDEAVQNAESIIAGLNNPTINKGNVSSATQAVISSKNALDGVERLAQDKQTAGNSLNHLDQLTPAQQQALENQINNATTRDKVAEIIAQAQALNEAMKALKXSIKDQPQTEASSKFINEDQAQKDAYTQAVQHARRCLX

SEQ ID NO: 518 - protein, 55 aa
VAEIIAQAQALNEAMKALKESIKDQPQTEASSKFINEDQAQKDAYTQAVQHERKI

SEQ ID NO: 519 - protein, 229 aa
VVVLRMASNMPSLXKVENVEMIAFCDVDISKAASAAEAYGTDNAKVYDDYKALLKDDTIDVIHVCTPNDSHCEITVAGLHAGKHVMCEKPMAKTTAEAQKMIDTAKSTGKKLTIGYQNRFRPDSQFLHQAAQRGDLGDIYFGKAHAIRRRAVPTWGVFLNEEAQGGGPLIDIGTHALDLTLWMMDNYEPESVMGSTFHKLNKQHDAPNAWGSWNPDELTVEDSAFGFIK

SEQ ID NO: 520 - protein, 101 aa
VDEAKCSLLGTKAGADMKDVLRIHGEDMGTLYTKHVEXENKGVDFYEGNEVDEAEEEXKAWIDAVVNDTEPVVKPEQAMVVTKILEAIYQSAKSGKAIYFE

SEQ ID NO: 521 - protein, 61 aa
VDPPGCRNSTRTRAAFTVASIDLGAHPEFLGKNDIQLXKKESVEDTXKVLGRMFDGIEFKL

SEQ ID NO: 522 - protein, 123 aa
VIPNEFLKHSGKVHAQAFFTQNGSNNVVVERQFSFNIENDLVSGXDGITKLVYIKSIQDTIEAVGKDFNQLKQNMADTQTLIAKVNDSATKGIQQIEIKQNEAIQAITATQTSATQAVTAEVG

SEQ ID NO: 523 - protein, 229 aa
VMNIINLEKPKGVVVQFGGQTAINLADKLAKHGVKILGTSLENLNRAEDRKEFEALLRKINVPQPQGKSATSPEEALANAAEIGYPVVVRPSYVLGGRAMEIVDNDKELENYMTQAVKASPEHPVLVDRYLTGKEIEVDAICDGETVIIPGIMEHIERAGVHSGDSIAVYPPQTLTEDELATLEDYTIKLAKGLNIIGLINIQFVIAHDGVYCFRSKPTVLVERXHSRA

SEQ ID NO: 524 - protein, 90 aa
VIFMTNNKVALVTGGAQGIGFKIAERLVEDGFKVAVVDFNEEGAKAAALKLSSDGTKAIAIKADVSNRDDVFNAVRQATPSAIWRFPCHG

SEQ ID NO: 525 - protein, 191 aa
VRIHYVDIIMFKDVVIWEVCLIRLLVIKVLKRMIFARAKFEKEYGVKLNPKAGKDNHEMVEGIHDGEVHSLYLYGEDTGIVDSNINFVQAAFEKLDFMVVQDEFLTFTATYADVVLPASPSLEKDGTFTNTERRIQRLYQALEPLGDSKPDWKIFQAIANRLGIWIGITSILVKLWIEGRTLNTSICWGKL

SEQ ID NO: 526 - protein, 123 aa
VPIRHERXDKCEXIMYADNMTDXMKYAIDETQRRREIQMKHNEKHGITPKTINKXVHDLISATVENDENXDXAQTVIPKKMPKRARXKTIDNIEKEMKQAAKDLDFEKAXELRDMLFELKAXG

SEQ ID NO: 527 - protein, 46 aa
VXANEIXKXKIDANKDVDKQVQALIDEIDRNPNLTDKEKQALKRSY

SEQ ID NO: 528 - protein, 154 aa
VSEFNEIIIATPAQWISHTQDILKKYNITDQRVKVVAGGXDRNETIMNIIDHIRNVNGINNDDVIVTHDAVRPFLTQRIIKENIEVAXXYGAVDTVIEAIDTIVMSKDKQNIHSIPVRNEMYQGQTPQSFNIKLLQDSYRALSSEPXRNLIRCM

SEQ ID NO: 529 - protein, 124 aa
VLFTSDSRPTMSGNFEYIYNEMLRQNLDKKYDIHTVFKANITDRRGIIDKFRLPYLLGKADYIFVDDFHPLIYTVRFRRSQEVIQVWHAVGAFKTVGFSRTGKKGGPFIDSLNHRSSCQSLCII

SEQ ID NO: 530 - protein, 48 aa
VXHAVGAFKTVGFSRTGXKGGPFIDSLKPIVVTPKAYVSSETRYSILC

SEQ ID NO: 531 - protein, 27 aa
VYFDLGKTSGSGTNANKVTITKIMGWK

SEQ ID NO: 532 - protein, 128 aa
VEIMKITVNDKNEVIGYVNTGGLRNSLDVDDNNVPIKFKEEFEPRKFVFTNGEIKYNSNFEKEDVPNASSQQSESDLSDEELRGMVASMQMQVAQVNVLTMELAQQNAMLTQQLTELKTNKTSTEGDV

SEQ ID NO: 533 - protein, 377 aa
VRQLAQAKKKSTAKKKTASKKRTNSRKKKNDNPIRYVIAILVVVLMVLGVFQLGIIGRLIDSFFNYLFGYSRYLTYILVLLATGFITYSKRIPKTRRTAGSIVLQIALLFVSQLVFHFNSGIKAEREPVLSYVYQSYQHSHFPNFGGGVLGFYLLELSVPLISLFGVCIITILLLCSSVILLTNHQHRDVAKVALENIKAWFGSFNEKMSERNQEKQLKREEKARLKEEQKARQNEQPQIKDVSDFTEVPQERDIPIYGHTENESKSQCQPSRKKRVFDAENSSNNIVNHQADQQEQLTEQTHNSVESENTIEEAGEVTNVSYVVPPLTLLNQPAKQKATSKAEVQRKGQVPKRYXKRFWGXIXKXTQXKLSXSNSI

SEQ ID NO: 534 - protein, 186 aa
VMTEEXCLLKRVFMRMKRFLTIVQILLVVIIIIFGYKIVQTYIEDKQERAXYEKLQXKFXMLMXKHQEHVRPQFESLEKINKDIVGWIKLSGTSLXYPVLQGKTNHDYLNLDFEREHRRKGSIFMDFRNELXNLNHNTILYGHHVGDNTMFDVLEDYLKQSFYEKHKIIGFDNKYGKYQLQVFSAY

What is claimed is:

1. An isolated polynucleotide segment comprising a nucleic acid sequence or the full complement of the entire length of the nucleic acid sequence, wherein the nucleic acid sequence is at least 95% identical to at least one of SEQ ID NO:3, 20, 128, 135, 153, 184, 201, 206, 215 or 234.

2. A vector comprising the isolated polynucleotide segment of claim 1.

3. An isolated host cell comprising the vector of claim 2.

4. The isolated polynucleotide segment of claim 1, wherein the nucleic acid sequence is at least 97% identical to at least one of SEQ ID NO:3, 20, 128, 135, 153, 184, 201, 206, 215 or 234.

5. The isolated polynucleotide segment of claim 1, wherein the nucleic acid sequence is at least 99% identical to at least one of SEQ ID NO:3, 20, 128, 135, 153, 184, 201, 206, 215 or 234.

6. The isolated polynucleotide segment of claim 1, wherein the nucleic acid sequence comprises at least one of SEQ ID NO:3, 20, 128, 135, 153, 184, 201, 206, 215 or 234.

7. A vector comprising the isolated polynucleotide segment of claim 6.

8. An isolated host cell comprising the vector of claim 7.

9. A process for producing a polypeptide comprising culturing the host cell of claim 8 under conditions sufficient for the production of the polypeptide and recovering the polypeptide, wherein the polypeptide is encoded by the nucleic acid sequence.

10. An isolated polynucleotide segment, comprising a sequence or the full complement of the entire length of the sequence, wherein the sequence is at least 95% identical to at least one of SEQ ID NO:3, 20, 128, 135, 153, 184, 201, 206, 215 or 234 and hybridizes to the full complement of at least one of SEQ ID NO:3, 20, 128, 135, 153, 184, 201, 206, 215 or 234 under hybridization conditions comprising incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.; wherein the nucleic acid sequence detects *Staphylococcus aureus* by hybridization.

11. The isolated polynucleotide segment of claim 10, wherein the nucleic acid sequences is at least 97% identical to the reference sequence and hybridizes to the full complement of the reference sequence under hybridization conditions comprising incubation at 42° C. in a solution comprising: 50% formamide, 5×SSC (150 mM NaCl, 15 mM trisodium citrate), 50 mM sodium phosphate (pH7.6), 5×Denhardt's solution, 10% dextran sulfate, and 20 micrograms/ml denatured, sheared salmon sperm DNA, followed by washing in 0.1×SSC at 65° C.

12. An isolated polynucleotide segment comprising a nucleic acid sequence or the full complement of the entire length of the nucleic acid sequence, wherein the nucleic acid sequence encodes a polypeptide comprising an amino acid sequence selected from (a) the amino acid sequence set forth in SEQ ID NO:262;
(b) the amino acid sequence set forth in SEQ ID NO:279;
(c) the amino acid sequence set forth in SEQ ID NO:393;
(d) the amino acid sequence set forth in SEQ ID NO:394;
(e) the amino acid sequence set forth in SEQ ID NO:401;
(f) the amino acid sequence set forth in SEQ ID NO:419;
(g) the amino acid sequence set forth in SEQ ID NO:451;
(h) the amino acid sequence set forth in SEQ ID NO:452;
(i) the amino acid sequence set forth in SEQ ID NO:469;
(j) the amino acid sequence set forth in SEQ ID NO:474;
(k) the amino acid sequence set forth in SEQ ID NO:475;
(l) the amino acid sequence set forth in SEQ ID NO:486; and,
(m) the amino acid sequence set forth in SEQ ID NO:506.

13. A vector comprising the isolated polynucleotide segment of claim 12.

14. An isolated host cell comprising the vector of claim 13.

15. A process for producing a polypeptide comprising culturing the host cell of claim 14 under conditions sufficient for the production of the polypeptide and recovering the polypeptide, wherein the polypeptide is encoded by the nucleic acid sequence.

16. The isolated polynucleotide segment of claim 12, wherein the nucleic acid sequence encodes a polypeptide comprising the amino acid sequence set forth in SEQ ID NO:262.

17. The isolated polynucleotide segment of claim 12, wherein the nucleic acid sequence encodes a polypeptide comprising the amino acid sequence set forth in SEQ ID NO:279.

18. The isolated polynucleotide segment of claim 12, wherein the nucleic acid sequence encodes a polypeptide comprising an amino acid sequence selected from the amino acid sequence set forth in SEQ ID NO:393 and the amino acid sequence set forth in SEQ ID NO:394.

19. The isolated polynucleotide segment of claim 12, wherein the nucleic acid sequence encodes a polypeptide comprising the amino acid sequence set forth in SEQ ID NO:401.

20. The isolated polynucleotide segment of claim 12, wherein the nucleic acid sequence encodes a polypeptide comprising the amino acid sequence set forth in SEQ ID NO:419.

21. The isolated polynucleotide segment of claim 12, wherein the nucleic acid sequence encodes a polypeptide comprising an amino acid sequence selected from the amino acid sequence set forth in SEQ ID NO:451 and the amino acid sequence set forth in SEQ ID NO:452.

22. The isolated polynucleotide segment of claim 12, wherein the nucleic acid sequence encodes a polypeptide comprising the amino acid sequence set forth in SEQ ID NO:469.

23. The isolated polynucleotide segment of claim 12, wherein the nucleic acid sequence encodes a polypeptide comprising an amino acid sequence selected from the amino acid sequence set forth in SEQ ID NO:474 and the amino acid sequence set forth in SEQ ID NO:475.

24. The isolated polynucleotide segment of claim 12, wherein the nucleic acid sequence encodes a polypeptide comprising the amino acid sequence set forth in SEQ ID NO:486.

25. The isolated polynucleotide segment of claim 12, wherein the nucleic acid sequence encodes a polypeptide comprising the amino acid sequence set forth in SEQ ID NO:506.

26. The isolated polynucleotide segment of claim 12, wherein the nucleic acid sequence encodes a polypeptide consisting of an amino acid sequence selected from
 (a) the amino acid sequence set forth in SEQ ID NO:262;
 (b) the amino acid sequence set forth in SEQ ID NO:279;
 (c) the amino acid sequence set forth in SEQ ID NO:393;
 (d) the amino acid sequence set forth in SEQ ID NO:394;
 (e) the amino acid sequence set forth in SEQ ID NO:401;
 (f) the amino acid sequence set forth in SEQ ID NO:419;
 (g) the amino acid sequence set forth in SEQ ID NO:451;
 (h) the amino acid sequence set forth in SEQ ID NO:452;
 (i) the amino acid sequence set forth in SEQ ID NO:469;
 (j) the amino acid sequence set forth in SEQ ID NO:474;
 (k) the amino acid sequence set forth in SEQ ID NO:475;
 (l) the amino acid sequence set forth in SEQ ID NO:486; and,
 (m) the amino acid sequence set forth in SEQ ID NO:506.

27. A vector comprising the isolated polynucleotide segment of claim 26.

28. An isolated host cell comprising the vector of claim 27.

29. A process for producing a polypeptide comprising culturing the host cell of claim 28 under conditions sufficient for the production of the polypeptide and recovering the polypeptide, wherein the polypeptide is encoded by the nucleic acid sequence.

* * * * *